US010745680B2

(12) United States Patent
Liu et al.

(10) Patent No.: US 10,745,680 B2
(45) Date of Patent: Aug. 18, 2020

(54) FACTOR IX FUSION PROTEINS AND METHODS OF MAKING AND USING SAME

(71) Applicant: Bioverativ Therapeutics Inc., Waltham, MA (US)

(72) Inventors: Zhiqian Liu, Winchester, MA (US); Arjan Van Der Flier, Somerville, MA (US); David R. Light, Somerville, MA (US); Ekta Seth Chhabra, Framingham, MA (US); Tongyao Liu, Lexington, MA (US); Robert T. Peters, Needham, MA (US); John Kulman, Belmont, MA (US); Ayman Ismail, Cambridge, MA (US)

(73) Assignee: Bioverativ Therapeutics Inc., Waltham, MA (US)

( * ) Notice: Subject to any disclaimer, the term of this patent is extended or adjusted under 35 U.S.C. 154(b) by 248 days.

(21) Appl. No.: 15/750,119

(22) PCT Filed: Aug. 3, 2016

(86) PCT No.: PCT/US2016/045401
§ 371 (c)(1),
(2) Date: Feb. 2, 2018

(87) PCT Pub. No.: WO2017/024060
PCT Pub. Date: Feb. 9, 2017

(65) Prior Publication Data
US 2018/0355341 A1 Dec. 13, 2018

Related U.S. Application Data

(60) Provisional application No. 62/281,993, filed on Jan. 22, 2016, provisional application No. 62/200,590, filed on Aug. 3, 2015.

(51) Int. Cl.
| | | |
|---|---|---|
| *C12N 9/64* | (2006.01) | |
| *C07K 14/745* | (2006.01) | |
| *A61K 9/00* | (2006.01) | |
| *A61P 7/04* | (2006.01) | |
| *C07K 14/00* | (2006.01) | |
| *A61K 38/00* | (2006.01) | |

(52) U.S. Cl.
CPC ............ *C12N 9/644* (2013.01); *A61K 9/0019* (2013.01); *A61P 7/04* (2018.01); *C07K 14/00* (2013.01); *C12Y 304/21022* (2013.01); *A61K 38/00* (2013.01); *C07K 2319/00* (2013.01); *C07K 2319/30* (2013.01)

(58) Field of Classification Search
CPC .......................... C12Y 304/21022; A61P 7/04
See application file for complete search history.

(56) References Cited

U.S. PATENT DOCUMENTS

| | | |
|---|---|---|
| 3,992,518 A | 11/1976 | Chien et al. |
| 4,088,864 A | 5/1978 | Theeuwes et al. |
| 4,179,337 A | 12/1979 | Davis et al. |
| 4,200,098 A | 4/1980 | Ayer et al. |
| 4,200,984 A | 5/1980 | Fink |
| 4,215,051 A | 7/1980 | Schroeder et al. |
| 4,284,444 A | 8/1981 | Bernstein et al. |
| 4,398,908 A | 8/1983 | Siposs |
| 4,435,173 A | 3/1984 | Siposs et al. |
| 4,456,591 A | 6/1984 | Thomas |
| 4,542,025 A | 9/1985 | Tice et al. |
| 4,599,311 A | 7/1986 | Kawasaki |
| 4,683,195 A | 7/1987 | Mullis et al. |
| 4,683,202 A | 7/1987 | Mullis |
| 4,684,479 A | 8/1987 | D'Arrigo |
| 4,704,362 A | 11/1987 | Itakura et al. |
| 4,713,339 A | 12/1987 | Levinson et al. |
| 4,757,006 A | 7/1988 | Toole et al. |
| 4,770,999 A | 9/1988 | Kaufman et al. |
| 4,784,950 A | 11/1988 | Hagen et al. |
| 4,800,159 A | 1/1989 | Mullis et al. |
| 4,845,075 A | 7/1989 | Murray et al. |
| 4,861,800 A | 8/1989 | Buyske |
| 4,868,112 A | 9/1989 | Toole, Jr. |
| 4,870,008 A | 9/1989 | Brake |
| 4,882,279 A | 11/1989 | Cregg |
| 4,897,268 A | 1/1990 | Tice et al. |
| 4,931,373 A | 6/1990 | Kawasaki et al. |
| 4,933,185 A | 6/1990 | Wheatley et al. |
| 4,965,188 A | 10/1990 | Mullis et al. |
| 4,965,199 A | 10/1990 | Capon et al. |

(Continued)

FOREIGN PATENT DOCUMENTS

| | | |
|---|---|---|
| AU | 609829 B2 | 5/1991 |
| CL | 201200238 | 1/2012 |

(Continued)

OTHER PUBLICATIONS

Kao et al. 2013; Incorportaion of the factor IX Padua mutation into FIX-triple improves clotting activity in vitro and in vivo. Thrombosis and Haemostasis. 110: 244-256.*

(Continued)

*Primary Examiner* — Karen Cochrane Carlson

(74) *Attorney, Agent, or Firm* — Lathrop GPM LLP; James H. Velema, Esq.

(57) ABSTRACT

The present invention provides Factor IX (FIX) fusion proteins comprising at least one heterologous moiety, such as an XTEN. The present invention further discloses methods of making and using the FIX fusion proteins.

27 Claims, 13 Drawing Sheets

Specification includes a Sequence Listing.

(56) References Cited

U.S. PATENT DOCUMENTS

| | | |
|---|---|---|
| 4,976,696 A | 12/1990 | Sanderson et al. |
| 4,988,337 A | 1/1991 | Ito |
| 4,994,371 A | 2/1991 | Davie et al. |
| 5,004,803 A | 4/1991 | Kaufman et al. |
| 5,004,804 A | 4/1991 | Kuo et al. |
| 5,017,378 A | 5/1991 | Turner et al. |
| 5,037,743 A | 8/1991 | Welch et al. |
| 5,089,474 A | 2/1992 | Castro et al. |
| 5,112,950 A | 5/1992 | Meulien et al. |
| 5,171,844 A | 12/1992 | Van Ooyen et al. |
| 5,176,502 A | 1/1993 | Sanderson et al. |
| 5,186,938 A | 2/1993 | Sablotsky et al. |
| 5,198,349 A | 3/1993 | Kaufman |
| 5,215,680 A | 6/1993 | D'Arrigo |
| 5,223,409 A | 6/1993 | Ladner et al. |
| 5,250,421 A | 10/1993 | Kaufman et al. |
| 5,270,176 A | 12/1993 | Dorschug et al. |
| 5,298,022 A | 3/1994 | Bernardi |
| 5,304,489 A | 4/1994 | Rosen |
| 5,318,540 A | 6/1994 | Athayde et al. |
| 5,364,771 A | 11/1994 | Lollar et al. |
| 5,364,934 A | 11/1994 | Drayna et al. |
| 5,407,609 A | 4/1995 | Tice et al. |
| 5,424,199 A | 6/1995 | Goeddel et al. |
| 5,492,534 A | 2/1996 | Athayde et al. |
| 5,534,617 A | 7/1996 | Cunningham et al. |
| 5,543,502 A | 8/1996 | Nordfang et al. |
| 5,554,730 A | 9/1996 | Woiszwillo et al. |
| 5,573,776 A | 11/1996 | Harrison et al. |
| 5,576,291 A | 11/1996 | Curtis et al. |
| 5,578,709 A | 11/1996 | Woiszwillo |
| 5,595,886 A | 1/1997 | Chapman et al. |
| 5,599,907 A | 2/1997 | Anderson et al. |
| 5,610,278 A | 3/1997 | Nordfang et al. |
| 5,643,575 A | 7/1997 | Martinez et al. |
| 5,648,260 A | 7/1997 | Winter et al. |
| 5,658,570 A | 8/1997 | Newman et al. |
| 5,660,848 A | 8/1997 | Moo-Young |
| 5,712,122 A | 1/1998 | Boime et al. |
| 5,736,137 A | 4/1998 | Anderson et al. |
| 5,739,277 A | 4/1998 | Presta et al. |
| 5,741,957 A | 4/1998 | Deboer et al. |
| 5,756,115 A | 5/1998 | Moo-Young et al. |
| 5,789,203 A | 8/1998 | Chapman et al. |
| 5,833,982 A | 11/1998 | Berkner et al. |
| 5,834,250 A | 11/1998 | Wells et al. |
| 5,837,679 A | 11/1998 | Wolf et al. |
| 5,846,951 A | 12/1998 | Gregoriadis |
| 5,849,992 A | 12/1998 | Meade et al. |
| 5,859,204 A | 1/1999 | Lollar |
| 5,869,046 A | 2/1999 | Presta et al. |
| 5,874,104 A | 2/1999 | Adler-Moore et al. |
| 5,916,588 A | 6/1999 | Popescu et al. |
| 5,919,766 A | 7/1999 | Osterberg et al. |
| 5,942,252 A | 8/1999 | Tice et al. |
| 5,965,156 A | 10/1999 | Proffitt et al. |
| 5,972,885 A | 10/1999 | Spira et al. |
| 5,981,216 A | 11/1999 | Kenten et al. |
| 5,981,719 A | 11/1999 | Woiszwillo et al. |
| 6,005,082 A | 12/1999 | Smeds |
| 6,024,983 A | 2/2000 | Tice et al. |
| 6,030,613 A | 2/2000 | Blumberg et al. |
| 6,043,094 A | 3/2000 | Martin et al. |
| 6,048,720 A | 4/2000 | Dalborg et al. |
| 6,056,973 A | 5/2000 | Allen et al. |
| 6,060,447 A | 5/2000 | Chapman et al. |
| 6,086,875 A | 7/2000 | Blumberg et al. |
| 6,090,925 A | 7/2000 | Woiszwillo et al. |
| 6,096,871 A | 8/2000 | Presta et al. |
| 6,110,498 A | 8/2000 | Rudnic et al. |
| 6,121,022 A | 9/2000 | Presta et al. |
| 6,126,966 A | 10/2000 | Abra et al. |
| 6,159,730 A | 12/2000 | Reff |
| 6,183,770 B1 | 2/2001 | Muchin et al. |
| 6,194,551 B1 | 2/2001 | Idusogie et al. |
| 6,228,620 B1 | 5/2001 | Chapman et al. |
| 6,242,195 B1 | 6/2001 | Idusogie et al. |
| 6,251,632 B1 | 6/2001 | Lillicrap et al. |
| 6,254,573 B1 | 7/2001 | Haim et al. |
| 6,268,053 B1 | 7/2001 | Woiszwillo et al. |
| 6,277,375 B1 | 8/2001 | Ward |
| 6,284,276 B1 | 9/2001 | Rudnic et al. |
| 6,294,170 B1 | 9/2001 | Boone et al. |
| 6,294,191 B1 | 9/2001 | Meers et al. |
| 6,294,201 B1 | 9/2001 | Kettelhoit et al. |
| 6,303,148 B1 | 10/2001 | Hennink et al. |
| 6,309,370 B1 | 10/2001 | Haim et al. |
| 6,310,183 B1 | 10/2001 | Johannessen et al. |
| 6,316,024 B1 | 11/2001 | Allen et al. |
| 6,316,226 B1 | 11/2001 | Van Ooyen et al. |
| 6,329,186 B1 | 12/2001 | Nielsen et al. |
| 6,346,513 B1 | 2/2002 | Van Ooyen et al. |
| 6,352,716 B1 | 3/2002 | Janoff et al. |
| 6,352,721 B1 | 3/2002 | Faour |
| 6,358,703 B1 | 3/2002 | Cho et al. |
| 6,361,796 B1 | 3/2002 | Rudnic et al. |
| 6,376,463 B1 | 4/2002 | Lollar |
| 6,395,302 B1 | 5/2002 | Hennink et al. |
| 6,406,632 B1 | 6/2002 | Safir et al. |
| 6,406,713 B1 | 6/2002 | Janoff et al. |
| 6,413,777 B1 | 7/2002 | Reff et al. |
| 6,458,387 B1 | 10/2002 | Scott et al. |
| 6,458,563 B1 | 10/2002 | Lollar |
| 6,485,726 B1 | 11/2002 | Blumberg et al. |
| 6,514,532 B2 | 2/2003 | Rudnic et al. |
| 6,517,859 B1 | 2/2003 | Tice et al. |
| 6,528,624 B1 | 3/2003 | Idusogie et al. |
| 6,534,090 B2 | 3/2003 | Puthli et al. |
| 6,538,124 B1 | 3/2003 | Idusogie et al. |
| 6,572,585 B2 | 6/2003 | Choi |
| 6,669,961 B2 | 12/2003 | Kim et al. |
| 6,696,245 B2 | 2/2004 | Winter et al. |
| 6,713,086 B2 | 3/2004 | Qiu et al. |
| 6,715,485 B1 | 4/2004 | Djupesland |
| 6,733,753 B2 | 5/2004 | Boone et al. |
| 6,737,056 B1 | 5/2004 | Presta |
| 6,743,211 B1 | 6/2004 | Prausnitz et al. |
| 6,759,057 B1 | 7/2004 | Weiner et al. |
| 6,770,744 B2 | 8/2004 | Lollar |
| 6,814,979 B2 | 11/2004 | Rudnic et al. |
| 6,818,439 B1 | 11/2004 | Jolly et al. |
| 6,821,505 B2 | 11/2004 | Ward |
| 6,833,352 B2 | 12/2004 | Johannessen et al. |
| 6,838,093 B2 | 1/2005 | Flanner et al. |
| 6,890,918 B2 | 5/2005 | Burnside et al. |
| 6,905,688 B2 | 6/2005 | Rosen et al. |
| 6,911,323 B2 | 6/2005 | Persson et al. |
| 6,919,311 B2 | 7/2005 | Lenting et al. |
| 6,945,952 B2 | 9/2005 | Kwon |
| 6,960,657 B2 | 11/2005 | Persson et al. |
| 6,998,253 B1 | 2/2006 | Presta et al. |
| 7,026,524 B2 | 4/2006 | Persson et al. |
| 7,041,635 B2 | 5/2006 | Kim et al. |
| 7,045,318 B2 | 5/2006 | Ballance |
| 7,083,784 B2 | 8/2006 | Dall'Acqua et al. |
| 7,091,321 B2 | 8/2006 | Gillies et al. |
| 7,125,841 B2 | 10/2006 | Sheehan |
| 7,138,505 B1 | 11/2006 | Kuo et al. |
| 7,176,288 B2 | 2/2007 | Persson et al. |
| 7,199,223 B2 | 4/2007 | Bossard et al. |
| 7,276,475 B2 | 10/2007 | DeFrees et al. |
| 7,276,593 B2 | 10/2007 | Vernet et al. |
| 7,294,513 B2 | 11/2007 | Wyatt |
| 7,317,091 B2 | 1/2008 | Lazar et al. |
| 7,329,640 B2 | 2/2008 | Vlasuk |
| 7,348,004 B2 | 3/2008 | Peters et al. |
| 7,404,956 B2 | 7/2008 | Peters et al. |
| 7,413,537 B2 | 8/2008 | Ladner et al. |
| 7,414,022 B2 | 8/2008 | Pedersen et al. |
| 7,442,778 B2 | 10/2008 | Gegg et al. |
| 7,452,967 B2 | 11/2008 | Bertin |
| 7,507,406 B2 | 3/2009 | Gillies et al. |
| 7,511,024 B2 | 3/2009 | Pedersen et al. |
| 7,514,257 B2 | 4/2009 | Lee et al. |

(56) References Cited

U.S. PATENT DOCUMENTS

| | | |
|---|---|---|
| 7,528,242 B2 | 5/2009 | Anderson et al. |
| 7,560,107 B2 | 7/2009 | Lollar |
| 7,566,701 B2 | 7/2009 | Diener et al. |
| 7,632,921 B2 | 12/2009 | Pan et al. |
| 7,645,860 B2 | 1/2010 | Turecek et al. |
| 7,700,733 B2 | 4/2010 | Haaning et al. |
| 7,700,734 B2 | 4/2010 | Lin et al. |
| 7,786,070 B2 | 8/2010 | Johannessen et al. |
| 7,790,415 B2 | 9/2010 | Gillies et al. |
| 7,846,445 B2 | 12/2010 | Schellenberger et al. |
| 7,846,455 B2 | 12/2010 | Collins et al. |
| 7,855,279 B2 | 12/2010 | Schellenberger et al. |
| 7,862,820 B2 | 1/2011 | Peters et al. |
| 7,884,075 B2 | 2/2011 | Scheiflinger et al. |
| 7,939,632 B2 | 5/2011 | Metzner et al. |
| 8,357,779 B2 | 1/2013 | Scheiflinger et al. |
| 8,492,530 B2 | 7/2013 | Schellenberger et al. |
| 8,563,521 B2 | 10/2013 | Skerra et al. |
| 8,575,104 B2 | 11/2013 | Weimer et al. |
| 8,673,860 B2 | 3/2014 | Schellenberger et al. |
| 8,680,050 B2 | 3/2014 | Schellenberger et al. |
| 8,703,717 B2 | 4/2014 | Schellenberger et al. |
| 8,716,448 B2 | 5/2014 | Schellenberger et al. |
| 8,754,194 B2 | 6/2014 | Schulte et al. |
| 8,835,388 B2 | 9/2014 | Scheiflinger et al. |
| 8,933,197 B2 | 1/2015 | Stemmer et al. |
| 9,062,299 B2 | 6/2015 | Schellenberger et al. |
| 9,168,312 B2 | 10/2015 | Schellenberger et al. |
| 9,371,369 B2 | 6/2016 | Schellenberger et al. |
| 9,376,672 B2 | 6/2016 | Schellenberger et al. |
| 9,758,776 B2 | 9/2017 | Schellenberger et al. |
| 9,926,351 B2 | 3/2018 | Schellenberger et al. |
| 2002/0042079 A1 | 4/2002 | Simon et al. |
| 2002/0150881 A1 | 10/2002 | Ladner et al. |
| 2003/0049689 A1 | 3/2003 | Edwards et al. |
| 2003/0069395 A1 | 4/2003 | Sato et al. |
| 2003/0181381 A1 | 9/2003 | Himmelspach et al. |
| 2003/0190740 A1 | 10/2003 | Altman |
| 2003/0228309 A1 | 12/2003 | Salcedo et al. |
| 2003/0235536 A1 | 12/2003 | Blumberg et al. |
| 2004/0043446 A1 | 3/2004 | DeFrees et al. |
| 2004/0101740 A1 | 5/2004 | Sanders |
| 2004/0106118 A1 | 6/2004 | Kolmar et al. |
| 2004/0192599 A1 | 9/2004 | Schuh et al. |
| 2004/0203107 A1 | 10/2004 | Murray |
| 2004/0259780 A1 | 12/2004 | Glasebrook et al. |
| 2005/0042721 A1 | 2/2005 | Fang et al. |
| 2005/0048512 A1 | 3/2005 | Kolkman et al. |
| 2005/0100990 A1 | 5/2005 | Saenko et al. |
| 2005/0118136 A1 | 6/2005 | Leung et al. |
| 2005/0123997 A1 | 6/2005 | Lollar |
| 2005/0260605 A1 | 11/2005 | Punnonen et al. |
| 2005/0287153 A1 | 12/2005 | Dennis |
| 2006/0026719 A1 | 2/2006 | Kieliszewski et al. |
| 2006/0040856 A1 | 2/2006 | DeFrees et al. |
| 2006/0074199 A1 | 4/2006 | Hirata et al. |
| 2006/0084113 A1 | 4/2006 | Ladner et al. |
| 2006/0115876 A1 | 6/2006 | Pan et al. |
| 2006/0122376 A1 | 6/2006 | Chapman et al. |
| 2006/0205036 A1 | 9/2006 | Ostergaard et al. |
| 2006/0211621 A1 | 9/2006 | Knudsen et al. |
| 2006/0287220 A1 | 12/2006 | Li et al. |
| 2006/0293232 A1 | 12/2006 | Levy et al. |
| 2006/0293238 A1 | 12/2006 | Kaufman et al. |
| 2007/0021494 A1 | 1/2007 | Taveras et al. |
| 2007/0048282 A1 | 3/2007 | Rosen et al. |
| 2007/0161087 A1 | 7/2007 | Glaesner et al. |
| 2007/0191272 A1 | 8/2007 | Stemmer et al. |
| 2007/0191597 A1 | 8/2007 | Jain et al. |
| 2007/0203058 A1 | 8/2007 | Lau et al. |
| 2007/0212703 A1 | 9/2007 | Stemmer et al. |
| 2007/0231329 A1 | 10/2007 | Lazar et al. |
| 2007/0237765 A1 | 10/2007 | Lazar et al. |
| 2007/0237766 A1 | 10/2007 | Lazar et al. |
| 2007/0237767 A1 | 10/2007 | Lazar et al. |
| 2007/0243188 A1 | 10/2007 | Lazar et al. |
| 2007/0244301 A1 | 10/2007 | Siekmann et al. |
| 2007/0248603 A1 | 10/2007 | Lazar et al. |
| 2008/0004206 A1 | 1/2008 | Rosen et al. |
| 2008/0033413 A1 | 2/2008 | Inochkin et al. |
| 2008/0039341 A1 | 2/2008 | Schellenberger et al. |
| 2008/0057056 A1 | 3/2008 | Lazar et al. |
| 2008/0153751 A1 | 6/2008 | Rosen et al. |
| 2008/0161243 A1 | 7/2008 | Rosen et al. |
| 2008/0167219 A1 | 7/2008 | Lin et al. |
| 2008/0167238 A1 | 7/2008 | Rosen et al. |
| 2008/0176288 A1 | 7/2008 | Leung et al. |
| 2008/0193441 A1 | 8/2008 | Trown et al. |
| 2008/0194481 A1 | 8/2008 | Rosen et al. |
| 2008/0214462 A1 | 9/2008 | Dockal et al. |
| 2008/0227691 A1 | 9/2008 | Ostergaard et al. |
| 2008/0233100 A1 | 9/2008 | Chen et al. |
| 2008/0234193 A1 | 9/2008 | Bossard et al. |
| 2008/0260755 A1 | 10/2008 | Metzner et al. |
| 2008/0261877 A1 | 10/2008 | Ballance et al. |
| 2008/0269125 A1 | 10/2008 | Ballance et al. |
| 2008/0286808 A1 | 11/2008 | Schellenberger et al. |
| 2008/0312157 A1 | 12/2008 | Levy et al. |
| 2008/0318276 A1 | 12/2008 | Persson et al. |
| 2009/0011992 A1 | 1/2009 | Olsen et al. |
| 2009/0042787 A1 | 2/2009 | Metzner et al. |
| 2009/0058322 A1 | 3/2009 | Toma et al. |
| 2009/0060862 A1 | 3/2009 | Chang et al. |
| 2009/0087411 A1 | 4/2009 | Fares et al. |
| 2009/0092582 A1 | 4/2009 | Bogin et al. |
| 2009/0099031 A1 | 4/2009 | Stemmer et al. |
| 2009/0117104 A1 | 5/2009 | Baker et al. |
| 2009/0118185 A1 | 5/2009 | Fay et al. |
| 2009/0169553 A1 | 7/2009 | Day |
| 2009/0192076 A1 | 7/2009 | Matthiessen et al. |
| 2009/0250598 A1 | 10/2009 | Hamada et al. |
| 2009/0263380 A1 | 10/2009 | Gilles et al. |
| 2010/0022445 A1 | 1/2010 | Scheiflinger et al. |
| 2010/0081187 A1 | 4/2010 | Griffith et al. |
| 2010/0081615 A1 | 4/2010 | Pan et al. |
| 2010/0120664 A1 | 5/2010 | Schulte et al. |
| 2010/0130427 A1 | 5/2010 | Bossard et al. |
| 2010/0143326 A1 | 6/2010 | Rischel et al. |
| 2010/0189682 A1 | 7/2010 | Schellenberger et al. |
| 2010/0239554 A1 | 9/2010 | Schellenberger et al. |
| 2010/0260706 A1 | 10/2010 | Bogin et al. |
| 2010/0285021 A1 | 11/2010 | Jacquemin et al. |
| 2010/0292130 A1 | 11/2010 | Skerra et al. |
| 2010/0323956 A1 | 12/2010 | Schellenberger et al. |
| 2011/0046060 A1 | 2/2011 | Schellenberger et al. |
| 2011/0046061 A1 | 2/2011 | Schellenberger et al. |
| 2011/0077199 A1 | 3/2011 | Schellenberger et al. |
| 2011/0124565 A1 | 5/2011 | Hauser et al. |
| 2011/0151433 A1 | 6/2011 | Schellenberger et al. |
| 2011/0154516 A1* | 6/2011 | Stafford ............ C12N 9/644 |
| | | 800/13 |
| 2011/0172146 A1 | 7/2011 | Schellenberger et al. |
| 2011/0183907 A1 | 7/2011 | Weimer et al. |
| 2011/0286988 A1 | 11/2011 | Jiang et al. |
| 2011/0287041 A1 | 11/2011 | Carrico et al. |
| 2011/0288005 A1 | 11/2011 | Silverman et al. |
| 2011/0312881 A1 | 12/2011 | Silverman et al. |
| 2012/0065077 A1 | 3/2012 | Astermark et al. |
| 2012/0142593 A1 | 6/2012 | Zhao et al. |
| 2012/0178691 A1 | 7/2012 | Schellenberger et al. |
| 2012/0220011 A1 | 8/2012 | Schellenberger et al. |
| 2012/0230947 A1 | 9/2012 | Schellenberger et al. |
| 2012/0263701 A1 | 10/2012 | Schellenberger et al. |
| 2012/0263703 A1 | 10/2012 | Schellenberger et al. |
| 2012/0289468 A1 | 11/2012 | Barnett |
| 2012/0308540 A1 | 12/2012 | Madison et al. |
| 2013/0017997 A1 | 1/2013 | Schellenberger et al. |
| 2013/0039884 A1 | 2/2013 | Bogin et al. |
| 2013/0108629 A1 | 5/2013 | Dumont et al. |
| 2013/0165389 A1 | 6/2013 | Schellenberger et al. |
| 2013/0171175 A1 | 7/2013 | Pierce et al. |
| 2013/0172274 A1 | 7/2013 | Chilkoti |
| 2013/0183280 A1 | 7/2013 | Oestergaard et al. |
| 2014/0018297 A1 | 1/2014 | Bolt et al. |

(56) References Cited

U.S. PATENT DOCUMENTS

| | | |
|---|---|---|
| 2014/0050693 A1 | 2/2014 | Skerra et al. |
| 2014/0072561 A1 | 3/2014 | Weimer et al. |
| 2014/0186327 A1 | 7/2014 | Schellenberger et al. |
| 2014/0273096 A1 | 9/2014 | Schulte et al. |
| 2014/0301974 A1 | 10/2014 | Schellenberger et al. |
| 2014/0328819 A1 | 11/2014 | Schellenberger et al. |
| 2014/0356326 A1 | 12/2014 | Schellenberger et al. |
| 2014/0371136 A1 | 12/2014 | Schellenberger et al. |
| 2015/0023959 A1 | 1/2015 | Chhabra et al. |
| 2015/0038421 A1 | 2/2015 | Schellenberger et al. |
| 2015/0158929 A1 | 6/2015 | Schellenberger et al. |
| 2015/0175503 A1 | 6/2015 | Marks et al. |
| 2015/0259431 A1 | 9/2015 | Stemmer et al. |
| 2015/0266943 A1 | 9/2015 | Chhabra et al. |
| 2015/0344862 A1 | 12/2015 | Schellenberger et al. |
| 2016/0115467 A1 | 4/2016 | Salas |
| 2016/0355568 A1 | 12/2016 | Kulman |
| 2016/0362672 A1 | 12/2016 | Schellenberger et al. |
| 2017/0247676 A1 | 8/2017 | Schellenberger et al. |

FOREIGN PATENT DOCUMENTS

| | | |
|---|---|---|
| CL | 201402183 | 9/2015 |
| CL | 201502719 A1 | 4/2016 |
| CN | 1761684 A | 4/2006 |
| CN | 101190945 A | 6/2008 |
| EP | 0 036 776 A3 | 10/1982 |
| EP | 0 154 316 A2 | 9/1985 |
| EP | 0 184 438 A3 | 1/1988 |
| EP | 0 272 277 A1 | 6/1988 |
| EP | 0 244 234 A3 | 10/1988 |
| EP | 0 295 597 A2 | 12/1988 |
| EP | 0 238 023 A3 | 2/1989 |
| EP | 0 401 384 A1 | 12/1990 |
| EP | 0 272 277 B1 | 9/1993 |
| EP | 1 203 014 B1 | 10/2004 |
| EP | 0 506 757 B2 | 10/2005 |
| EP | 1 252 192 B1 | 8/2006 |
| EP | 1 935 430 A1 | 6/2008 |
| EP | 2 256 135 A1 | 12/2010 |
| EP | 2 173 890 B1 | 3/2011 |
| EP | 2 371 856 A2 | 10/2011 |
| EP | 2 032 607 B1 | 1/2014 |
| EP | 2 796 145 A1 | 10/2014 |
| EP | 3 331 608 A1 | 6/2018 |
| WO | WO 1987/004187 A1 | 7/1987 |
| WO | WO 1988/000831 A1 | 2/1988 |
| WO | WO 1988/003558 A1 | 5/1988 |
| WO | WO 1988/007089 A1 | 9/1988 |
| WO | WO 1988/007220 A1 | 9/1988 |
| WO | WO 1988/008035 A1 | 10/1988 |
| WO | WO 1989/009051 A1 | 10/1989 |
| WO | WO 1991/009122 A1 | 6/1991 |
| WO | WO 1992/010576 A1 | 6/1992 |
| WO | WO 1992/016221 A1 | 10/1992 |
| WO | WO 1993/020093 A1 | 10/1993 |
| WO | WO 1994/011503 A2 | 5/1994 |
| WO | WO 1995/034326 A1 | 12/1995 |
| WO | WO 1996/014339 A1 | 5/1996 |
| WO | WO 1997/033552 A1 | 9/1997 |
| WO | WO 1998/005787 A1 | 2/1998 |
| WO | WO 1998/022577 A1 | 5/1998 |
| WO | WO 1998/023289 A1 | 6/1998 |
| WO | WO 1998/052976 A1 | 11/1998 |
| WO | WO 1999/041383 A1 | 8/1999 |
| WO | WO 1999/049901 A1 | 10/1999 |
| WO | WO 1999/051642 A1 | 10/1999 |
| WO | WO 1999/058572 A1 | 11/1999 |
| WO | WO 2000/003317 A1 | 1/2000 |
| WO | WO 2000/009560 A2 | 2/2000 |
| WO | WO 2000/032767 A1 | 6/2000 |
| WO | WO 2000/042072 A2 | 7/2000 |
| WO | WO 2001/087922 A2 | 11/2001 |
| WO | WO 2002/044215 A2 | 6/2002 |
| WO | WO 2002/060919 A2 | 8/2002 |
| WO | WO 2002/040544 A3 | 10/2002 |
| WO | WO 2002/077036 A2 | 10/2002 |
| WO | WO 2002/079232 A2 | 10/2002 |
| WO | WO 2003/020764 A2 | 3/2003 |
| WO | WO 2003/074569 A2 | 9/2003 |
| WO | WO 2003/077834 A2 | 9/2003 |
| WO | WO 2004/016750 A2 | 2/2004 |
| WO | WO 2004/029207 A2 | 4/2004 |
| WO | WO 2004/035752 A2 | 4/2004 |
| WO | WO 2004/044859 A1 | 5/2004 |
| WO | WO 2004/063351 A2 | 7/2004 |
| WO | WO 2004/074455 A2 | 9/2004 |
| WO | WO 2004/081053 A1 | 9/2004 |
| WO | WO 2004/099249 A2 | 11/2004 |
| WO | WO 2005/016455 A2 | 2/2005 |
| WO | WO 2005/025499 A2 | 3/2005 |
| WO | WO 2005/025499 A3 | 5/2005 |
| WO | WO 2005/040217 A2 | 5/2005 |
| WO | WO 2005/047327 A2 | 5/2005 |
| WO | WO 2005/069845 A2 | 8/2005 |
| WO | WO 2005/070963 A1 | 8/2005 |
| WO | WO 2005/077981 A2 | 8/2005 |
| WO | WO 2005/092925 A2 | 10/2005 |
| WO | WO 2005/123780 A2 | 12/2005 |
| WO | WO 2006/019447 A1 | 2/2006 |
| WO | WO 2006/047350 A2 | 5/2006 |
| WO | WO 2006/053299 A2 | 5/2006 |
| WO | WO 2006/081249 A2 | 8/2006 |
| WO | WO 2006/085967 A2 | 8/2006 |
| WO | WO 2006/081249 A3 | 2/2007 |
| WO | WO 2007/021494 A2 | 2/2007 |
| WO | WO 2007/073486 A2 | 6/2007 |
| WO | WO 2007/090584 A1 | 8/2007 |
| WO | WO 2007/103455 A2 | 9/2007 |
| WO | WO 2007/103515 A2 | 9/2007 |
| WO | WO 2007/103455 A3 | 11/2007 |
| WO | WO 2007/144173 A1 | 12/2007 |
| WO | WO 2007/149406 A2 | 12/2007 |
| WO | WO 2008/033413 A2 | 3/2008 |
| WO | WO 2008/049931 A1 | 5/2008 |
| WO | WO 2008/077616 A1 | 7/2008 |
| WO | WO 2008/118507 A2 | 10/2008 |
| WO | WO 2008/155134 A1 | 12/2008 |
| WO | WO 2009/023270 A2 | 2/2009 |
| WO | WO 2009/051717 A2 | 4/2009 |
| WO | WO 2009/058322 A1 | 5/2009 |
| WO | WO 2009/062100 A1 | 5/2009 |
| WO | WO 2009/130198 A2 | 10/2009 |
| WO | WO 2009/137254 A2 | 11/2009 |
| WO | WO 2009/140015 A2 | 11/2009 |
| WO | WO 2009/149303 A1 | 12/2009 |
| WO | WO 2009/156137 A1 | 12/2009 |
| WO | WO 2010/060081 A1 | 5/2010 |
| WO | WO 2010/062768 A1 | 6/2010 |
| WO | WO 2010/091122 A1 | 8/2010 |
| WO | WO 2010/111414 A1 | 9/2010 |
| WO | WO 2010/144502 A2 | 12/2010 |
| WO | WO 2010/144508 A1 | 12/2010 |
| WO | WO 2011/014890 A1 | 2/2011 |
| WO | WO 2011/020866 A2 | 2/2011 |
| WO | WO 2011/028228 A1 | 3/2011 |
| WO | WO 2011/028229 A1 | 3/2011 |
| WO | WO 2011/028344 A2 | 3/2011 |
| WO | WO 2011/060242 A2 | 5/2011 |
| WO | WO 2011/069164 A2 | 6/2011 |
| WO | WO 2011/084808 A2 | 7/2011 |
| WO | WO 2011/101242 A1 | 8/2011 |
| WO | WO 2011/101284 A1 | 8/2011 |
| WO | WO 2011/123813 A2 | 10/2011 |
| WO | WO 2012/006623 A1 | 1/2012 |
| WO | WO 2012/006624 A2 | 1/2012 |
| WO | WO 2012/006633 A1 | 1/2012 |
| WO | WO 2012/006635 A1 | 1/2012 |
| WO | WO 2012/007324 A2 | 1/2012 |
| WO | WO 2012/170969 A2 | 12/2012 |
| WO | WO 2013/106787 A1 | 7/2013 |
| WO | WO 2013/121416 A1 | 8/2013 |
| WO | WO 2013/122617 A1 | 8/2013 |
| WO | WO 2013/123457 A1 | 8/2013 |

(56) References Cited

FOREIGN PATENT DOCUMENTS

| WO | WO 2013/160005 | A1 | 10/2013 |
|---|---|---|---|
| WO | WO 2014/011819 | A2 | 1/2014 |
| WO | WO14011819 | * | 1/2014 |
| WO | WO 2014/101287 | A1 | 7/2014 |
| WO | WO 2014/144549 | A1 | 9/2014 |
| WO | WO 2014/173873 | A1 | 10/2014 |
| WO | WO 2014/194282 | A2 | 12/2014 |
| WO | WO 2014/198699 | A2 | 12/2014 |
| WO | WO 2014/210558 | A1 | 12/2014 |
| WO | WO 2015/023891 | A2 | 2/2015 |
| WO | WO 2015/106052 | A1 | 7/2015 |
| WO | WO 2017/024060 | A1 | 2/2017 |

OTHER PUBLICATIONS

Peters et al. 2010; Prolonged activity of factor IS as a monomeric Fc Fusion protein.Thrombosis and Hemostasis. 115 (10); 2057-2064.*

(May 9, 2008) "Approval Letter—NovoSeven", U.S. Food and Drug Administration, Department of Health and Human Services, accessed at http://www.fda.gov/BiologicsBloodVaccines/BloodBloodProducts/ApprovedProducts/LicensedProductsBLAs/FractionatedPlasmaProducts/ucm056956.htm#, 1 Page.

(Jan. 15, 2010) "Approval Letter—NovoSeven", U.S. Food and Drug Administration, Department of Health and Human Services, accessed at http://www.fda.gov/BiologicsBloodVaccines/BloodBloodProducts/ApprovedProducts/LicensedProductsBLAs/FractionatedPlasmaProducts/ucm201608.htm#, 1 Page.

Ackerman, et al. (1997) "Ion Channels—Basic Science and Clinical Disease", The New England Journal of Medicine, vol. 336, No. 22, pp. 1575-1586.

Adams, et al. (2001) "High Affinity Restricts the Localization and Tumor Penetration of Single-Chain Fv Antibody Molecules", Cancer Research, vol. 61, No. 12, pp. 4750-4755.

Adams, et al. (1998) "Increased Affinity Leads to Improved Selective Tumor Delivery of Single-Chain Fv Antibodies", Cancer Research, vol. 58, No. 3, pp. 485-490.

Agersoe, et al. (Jul. 2011) "Prolonged effect of N8-Gp in Haemophilia A dogs supports less frequent dosing", Journal of Thrombosis and Haemostasis, vol. 9, Supplement 2, P-MO-181, ISTH Meeting, International Society on Thrombosis and Haemostasis, United States.

Ahmad, et al. (May 1, 2004) "ASA View: Database and Tool for Solvent Accessibility Representation in Proteins", BMC Bioinformatics, vol. 5, No. 51, pp. 1-5.

Alam, et al. (1998) "Expression and Purification of a Mutant Human Growth Hormone That Is Resistant to Proteolytic Cleavage by Thrombin, Plasmin and Human Plasma In Vitro", Journal of Biotechnology, vol. 65, No. 2-3, Elsevier Science Publishers, Netherlands, pp. 183-190.

Algiman, et al. (1992) "Natural Antibodies to Factor VIII (Anti-Hemophilic Factor) in Healthy Individuals", Proceedings of the National Academy of Sciences, vol. 89, No. 9, pp. 3795-3799.

Altschul, et al. (Oct. 5, 1990) "Basic Local Alignment Search Tool", Journal of Molecular Biology, vol. 215, No. 3, pp. 403-410.

Alvarez, et al. (Jan. 30, 2003) "Improving Protein Pharmacokinetics by Genetic Fusion to Simple Amino Acid Sequences", Journal of Biological Chemistry, vol. 279, No. 5, pp. 3375-3381.

Amin, et al. (2004) "Construction of Stabilized Proteins by Combinatorial Consensus Mutagenesis", Protein Engineering, Design & Selection: PEDS, vol. 17, No. 11, pp. 787-793.

Andersson, et al. (Sep. 1975) "Purification and Characterization of Human Factor IX", Thrombosis Research, vol. 7, Issue 3, pp. 451-459.

Ansong, et al. (2006) "Epitope Mapping Factor VIII A2 Domain by Affinity-Directed Mass Spectrometry: Residues 497-510 and 584-593 Comprise a Discontinuous Epitope for the Monoclonal Antibody R8B 12", Journal of Thrombosis and Haemostasis, vol. 4, No. 4, pp. 842-847.

Antcheva (2001) "Proteins of Circularly Permuted Sequence Present Within the Same Organism: the Major Serine Proteinase inhibitor from Capsicum Annuum Seeds", Protein Science, vol. 10, No. 11, pp. 2280-2290.

Appa, R, et al. (Aug. 2010) "Investigating Clearance Mechanisms for Recombinant Activated Factor VII in a Perfused Liver Model", Journal of Thrombosis and Haemostasis, vol. 104, No. 2, pp. 243-251.

Araki, et al. (1990) "Four Disulfide Bonds' Allocation of Na+, K+-ATPase Inhibitor (SPAI)", Biochemical and Biophysical Research Communications, vol. 172, No. 1, pp. 42-46.

Arap, et al. (2002) "Steps Toward Mapping the Human Vasculature by Phage Display", Nature Medicine, vol. 8, No. 2, pp. 121-127.

Armour, et al. (Aug. 1999) "Recombinant Human IgG Molecules Lacking Fc gamma Receptor I Binding and Monocyte Triggering Activities", European Journal of Immunology, vol. 29, No. 8, pp. 2613-2624.

Arnau, et al. (Jul. 2006) "Current Strategies for the Use of Affinity Tags and Tag Removal for the Purification of Recombinant Proteins", Protein Expression and Purification, vol. 48, No. 1, pp. 1-13.

Arndt, et al. (1998) "Factors Influencing the Dimer to Monomer Transition of an Antibody Single-Chain Fv Fragment", Biochemistry, vol. 37, pp. 12918-12926.

Arruda, et al. (Jan. 1, 2001) "Posttranslational Modifications of Recombinant Myotube-Synthesized Human Factor Ix", Blood, vol. 97, No. 1, pp. 130-138.

Assadi-Porter, et al. (2000) "Sweetness Determinant Sites of Brazzein, A Small, Heat-Stable, Sweet-Tasting Protein", Archives of Biochemistry and Biophysics, vol. 376, No. 2, pp. 259-265.

Bachmann, et al. (1995) "T Helper Cell-Independent Neutralizing B Cell Response Against Vesicular Stomatitis Virus: Role of Antigen Patterns in B Cell Induction", European Journal of Immunology, vol. 25, No. 12, pp. 3445-3451.

Bai, et al. (May 17, 2005) "Recombinant Granulocyte Colony-Stimulating Factor-Transferrin Fusion Protein As an Oral Myelopoietic Agent", Proceedings of the National Academy of Sciences of the United States of America, vol. 102, No. 20, pp. 7292-7296.

Bailon, et al. (2001) "Rational Design of a Potent, Long-Lasting Form of Interferon: A 40 kDa Branched Polyethylene Glycol-Conjugated Interferon α-2a for the Treatment of Hepatitis C", Bioconjugate Chemistry, vol. 12, No. 2, pp. 195-202.

Bajaj, et al. (1993) "Human Factor IX and Factor IXa", Methods in Enzymology, vol. 222, pp. 96-128.

Baneyx, et al. (2004) "Recombinant Protein Folding and Misfolding in *Escherichia coli*", Nature Biotechnology, vol. 22, No. 11, pp. 1399-1408.

Barrowcliffe, et al. (Jun. 2002) "Coagulation and Chromogenic Assays of Factor VIII Activity: General Aspects, Standardization, and Recommendations", Seminars in Thrombosis and Hemostasis, vol. 28, No. 3, pp. 247-256.

Barta, et al. (2002) "Repeats With Variations: Accelerated Evolution of the Pin2 Family of Proteinase Inhibitors", TRENDS in Genetics, vol. 18, No. 12, pp. 600-603.

Bateman, et al. (1998) "Granulins: the Structure and Function of an Emerging Family of Growth Factors,", The Journal of Endocrinology, vol. 158, No. 2, pp. 145-151.

Belaaouaj, et al. (2000) "Matrix Metalloproteinases Cleave Tissue Factor Pathway Inhibitor Effects on Coagulation", Journal of Biological Chemistry, vol. 275, No. 35, pp. 27123-27128.

Benhar, et al. (Dec. 1994) "Cloning, Expression and Characterization of the Fv Fragments of the Anti-Carbohydrate mAbs BI and B5 As Single-Chain Immunotoxins", Protein Engineering, Design and Selection, vol. 7, No. 12, pp. 1509-1515.

Bensch, et al. (1995) "Hbd-1: A Novel Beta-Defensin from Human Plasma", FEBS Letters, vol. 368, No. 2, pp. 331-335.

Beste, et al. (1999) "Small Antibody-like Proteins with Prescribed Ligand Specificities Derived from the Lipocalin Fold", Proceedings of the National Academy of Sciences, vol. 96, No. 5, pp. 1898-1903.

Binz, et al. (2005) "Engineering Novel Binding Proteins from Nonimmunoglobulin Domains", Nature Biotechnology, vol. 23, No. 10, pp. 1257-1268.

Bird, et al. (Oct. 21, 1988) "Single-Chain Antigen-Binding Proteins", Science, vol. 242, No. 4877, pp. 423-426.

(56) References Cited

OTHER PUBLICATIONS

Bittner, et al. (1998) "Recombinant Human Erythropoietin (Rhepo) Loaded Poly (Lactide-Co-Glycolide) Microspheres: influence of the Encapsulation Technique and Polymer Purity on Micro sphere Characteristics", European Journal of Pharmaceutics and Biopharmaceutics vol. 45, No. 3, pp. 295-305.
Bjoern, S., et al. (Sep. 1986) "Activation of Coagulation Factor VII to VIIa", Research Disclosure, vol. 269, pp. 564-565.
Bjorkman, et al. (Nov. 1, 2001) "Pharmacokinetics of Coagulation Factors: Clinical Relevance for Patients with Haemophilia", Clinical Pharmacokinetics, vol. 40, No. 11, Adis International Ltd., New Zealand, pp. 815-832.
Blanchette, et al. (2004) "Principles of Transmucosal Delivery of therapeutic Agents", Biomedicine & Pharmacotherapy, vol. 58, No. 3, pp. 142-151.
Bobrow, R. S. (2005) "Excess Factor VIII: a Common Cause of Hypercoagulability", American Board of Family Medicine, United States, pp. 147-149.
Bodenmuller, et al. (1986) "The Neuropeptide Head Activator Loses Its Biological Activity by Dimerization", The EMBO Journal vol. 5, No. 8, pp. 1825-1829.
Boder, et al. (Sep. 26, 2000) "Directed Evolution of Antibody Fragments with Monovalent Femtomolar Antigen-Binding Affinity", Proceedings of the National Academy of Sciences, vol. 97, No. 20, pp. 10701-10705.
Boshart, et al. (1985) "A Very Strong Enhancer Is Located Upstream of an Immediate Early Gene of Human Cytomegalovirus", Cell, vol. 41, No. 2, pp. 521-530.
Bovenschen, et al. (2005) "LDL receptor cooperates with LDL receptor-related protein in regulating plasma levels of coagulation factor VIII in vivo", Blood, vol. 106, pp. 906-912.
Bovenschen, Niels (2010) "LDL Receptor Polymorphisms Revisited", Blood, vol. 116, No. 25, pp. 5439-5440.
Brandsma, et al. (Mar.-Apr. 2011) "Recombinant Human Transferrin: Beyond Iron Binding and Transport", Biotechnology Advances, vol. 29, No. 2, pp. 230-238.
Brandstetter, et al. (Oct. 10, 1995) "X-ray Structure of Clotting Factor IXa: Active Site and Module Structure Related to Xase Activity and Hemophilia B", Proceedings of the National Academy of Sciences of the United States of America, vol. 92, No. 21, pp. 9796-9800.
Briet, et al. (1994) "High Titer Inhibitors in Severe Haemophilia A: A Meta-analysis Based on Eight Long-term Follow-up Studies concerning Inhibitors Associated with Crude or Intermediate Purity Factor VIII Products", Journal of Thrombosis and Haemostasis, vol. 72, No. 1, pp. 162-164.
Brooks, et al. (Oct. 2002) "Evolution of Amino Acid Frequencies in Proteins Over Deep Time: Inferred Order of Introduction of Amino Acids into the Genetic Code", Molecular Biology and Evolution, vol. 19, No. 10, pp. 1645-1655.
Buchner, J. (1996) "Supervising the Fold: Functional Principles of Molecular Chaperones", FASEB Journal, vol. 10, No. 1, pp. 10-19.
Bulaj, et al. (2003) "Efficient Oxidative Folding of Conotoxins and the Radiation of Venomous Cone Snails", Proceedings of the National Academy of Sciences of the United States of America, vol. 100, Supplement 2, pp. 14562-14568.
Burmeister, et al. (Nov. 24, 1994) "Crystal Structure of the Complex of Rat Neonatal Fc Receptor With Fc", Nature, vol. 372, No. 6504, pp. 379-383.
Buscaglia, et al. (1999) "Tandem Amino Acid Repeats From Trypanosoma Cruzi Shed Antigens Increase the Half-Life of Proteins in Blood", Blood, vol. 93, No. 6, pp. 2025-2032.
Caliceti, et al. (1999) "Biopharmaceutical Properties of Uricase Conjugated to Neutral and Amphiphilic Polymers", Bioconjugate Chemistry, vol. 10, No. 4, pp. 638-646.
Caliceti, et al. (2003) "Pharmacokinetic and Biodistribution Properties of Poly (Ethylene Glycol)-Protein Conjugates", Advanced Drug Delivery Reviews, vol. 55, No. 10, pp. 1261-1277.
Calvete, et al. (2000) "Disulphide-Bond Pattern and Molecular Modelling of the Dimeric Disintegrin Emf-10, A Potent and Selective integrin Alpha5Beta1 Antagonist from Eristocophis Macmahoni Venom", The Biochemical Journal, vol. 345, Part 3, pp. 573-581.
Calvete, et al. (2005) "Snake Venom Disintegrins: Evolution of Structure and Function", Toxicon, vol. 45, No. 8, pp. 1063-1074.
Calvete, et al. (2003) "Snake Venom Disintegrins: Novel Dimeric Disintegrins and Structural Diversification by Disulphide Bond Engineering", The Biochemical Journal, vol. 372, Part 3, pp. 725-734.
Cameron, et al. (Feb. 1998) "The Canine Factor VIII cDNA and 5' Flanking Sequence", Journal of Thrombosis and Haemostasis, vol. 79, No. 2, pp. 317-322.
Cao, et al. (2006) "Development of a Compact Anti-Baff Antibody in *Escherichia coli*", Applied Microbiology and Biotechnology, vol. 73, No. 1, pp. 151-157.
Capon, et al. (Feb. 9, 1989) "Designing CD4 Immunoadhesins for AIDS Therapy", Nature, vol. 337, No. 6207, pp. 525-531.
Carr, et al. (1994) "Solution Structure of a Trefoil-Motif-Containing Cell Growth Factor, Porcine Spasmolytic Protein", Proceedings of the National Academy of Sciences of the United States of America, vol. 91, No. 6, pp. 2206-2210.
Chen, et al. (1991) "Crystal Structure of a Bovine Neurophysin Ii Dipeptide Complex At 2", Proceedings of the National Academy of Sciences of the United States of America vol. 88, No. 10, pp. 4240-4244.
Chen, et al. (2006) "Expression, Purification, and in Vitro Refolding of a Humanized Single-Chain Fv Antibody Against Human Ctla4 (Cd152)", Protein Expression and Purification, vol. 46, No. 2, pp. 495-502.
Chen, et al. (1993) "Site-Directed Mutations in a Highly Conserved Region of Bacillus Thuringiensis Delta-Endotoxin Affect inhibition of Short Circuit Current Across Bombyx Mori Midguts", Proceedings of the National Academy of Sciences of the United States of America vol. 90, No. 19, pp. 9041-9045.
Chirino, et al. (2004) "Minimizing the Immunogenicity of Protein Therapeutics", Drug Discovery Today, vol. 9, No. 2, pp. 82-90.
Cho, et al. (Nov. 22, 1994) "Polysialic Acid Engineering: Synthesis of Polysialylated Neoglycosphingolipids by Using the Polysialyltransferase From Neuroinvasive *Escherichia coli* K1", Proceedings of the National Academy of Sciences of the United States of America, vol. 91, No. 24, pp. 11427-11431.
Chong, et al. (2001) "Determination of Disulfide Bond assignments and NGlycosylation Sites of the Human Gastrointestinal Carcinoma Antigen Ga733-2 (Co17-1A, Egp, Ks1-4, Ksa, and Ep-Cam)", The Journal of Biological Chemistry, vol. 276, No. 8, pp. 5804-5813.
Chong, et al. (2002) "Disulfide Bond Assignments of Secreted Frizzled-Related Protein-1 Provide Insights About Frizzled Homology and Netrin Modules", The Journal of Biological Chemistry, vol. 277, No. 7, pp. 5134-5144.
Choo, et al. (1982) "Molecular Cloning of the Gene for Human Anti-Haemophilic Factor IX", Nature, vol. 299, No. 5879, pp. 178-180.
Chowdhury, et al. (1999) "Improving Antibody Affinity by Mimicking Somatic Hypermutation In Vitro", Nature Biotechnology, vol. 17, No. 6, pp. 568-572.
Christmann, et al. (1999) "The Cystine Knot of a Squash-Type Protease Inhibitor As a Structural Scaffold for *Escherichia coli* Cell Surface Display of Conformationally Constrained Peptides", Protein Engineering, vol. 12, No. 9, pp. 797-806.
Clark, et al. (1996) "Long-Acting Growth Hormones Produced by Conjugation With Polyethylene Glycol", Journal of Biological Chemistry, vol. 271, No. 36, pp. 21969-21977.
Clark, et al. (1996) "Recombinant Human Growth Hormone (GH)-Binding Protein Enhances the Growth-Promoting Activity of Human GH in the Rat", Endocrinology, vol. 137, No. 10, pp. 4308-4315.
Cleland, et al. (2009) "An Extended Half-life Exenatide Construct for Weekly Administration in the Treatment of Diabetes Mellitus", Diabetes, vol. 58, pp. A511-A512.
Coia, et al. (1997) "Use of Mutator Cells as a Means for increasing Production Levels of a Recombinant Antibody Directed Against Hepatitis B", Gene, vol. 201, No. 1-2, pp. 203-209.
Collen, et al. (Oct. 10, 2000) "Polyethylene Glycol-Derivatized Cysteine-Substitution Variants of Recombinant Staphylokinase for

(56) References Cited

OTHER PUBLICATIONS

Single-Bolus Treatment of Acute Myocardial Infarction", Circulation, vol. 102, Issue 15, pp. 1766-1772.
Conticello, et al. (Feb. 2001) "Mechanisms for Evolving Hypervariability: The Case of Conopeptides", Molecular Biology and Evolution, Oxford University Press, United States, vol. 18, Issue 2, pp. 120-131.
Corisdeo, et al. (Apr. 2004) "Functional Expression and Display of an Antibody Fab Fragment in *Escherichia coli*: Study of Vector Designs and Culture Conditions", Protein Expression and Purification, vol. 34, Issue 2, pp. 270-279.
Craik, et al. (Dec. 17, 1999) "Plant cyclotides: A Unique Family of Cyclic and Knotted Proteins that Defines the Cyclic Cystine Knot Structural Motif", Journal of Molecular Biology, vol. 294, Issue 5, Dec. 17, 1999, pp. 1327-1336.
Crameri, et al. (Apr. 1996) "Improved Green Fluorescent Protein by Molecular Evolution Using DNA Shuffling", Nature Biotechnology, vol. 14, No. 3, pp. 315-319.
Cull, et al. (Mar. 1, 1992) "Screening for Receptor Ligands Using Large Libraries of Peptides Linked to the C Terminus of the Lac Repressor", Proceedings of the National Academy of Sciences, vol. 89, No. 5, pp. 1865-1869.
Cutler, et al. (2002) "The Identification and Classification of 41 Novel Mutations in the Factor VIII Gene (F8c)", Human Mutation, vol. 19, No. 3, pp. 274-278.
Danner, et al. (Nov. 6, 2001) "T7 Phage Display: A Novel Genetic Selection System for Cloning RNA-Binding Proteins From cDNA Libraries", Proceedings of the National Academy of Sciences of the United States of America, vol. 98, No. 23, pp. 12954-12959.
Dauplais, et al. (Feb. 14, 1997) "On the Convergent Evolution of Animal Toxins", The Journal of Biological Chemistry, vol. 272, No. 7, pp. 4302-4309.
Davidson, et al. (2009) "Engineered Fluorescent Proteins: Innovations and Applications", Nature Methods, vol. 6, No. 10, pp. 713-717.
De Boer, et al. (1983) "The tac Promoter: A Functional Hybrid Derived From the trp and lac Promoters", Proceedings of the National Academy of Sciences, vol. 80, No. 1, pp. 21-25.
De Kruif, et al. (Apr. 21, 1995) "Selection and Application of Human Single Chain Fv Antibody Fragments From a Semi-Synthetic Phage Antibody Display Library With Designed CDR3 Regions", Journal of Molecular Biology, vol. 248, No. 1, pp. 97-105.
De, et al. (1994) "Crystal Structure of a Disulfide-Linked"Trefoil" Motif Found in a Large Family of Putative Growth Factors", Proceedings of the National Academy of Sciences, vol. 91, No. 3, pp. 1084-1088.
Deckert, et al. (2000) "Pharmacokinetics and Microdistribution of Polyethylene Glycol-Modified Humanized A33 Antibody Targeting Colon Cancer Xenografts", International Journal of Cancer, vol. 87, No. 3, pp. 382-390.
Delgado, et al. (1992) "The Uses and Properties of PEG-Linked Proteins", Critical Reviews in Therapeutic Drug Carrier Systems, vol. 9, No. 3-4, pp. 249-304.
Dennis, et al. (Sep. 20, 2002) "Albumin Binding as a General Strategy for Improving the Pharmacokinetics of Proteins", Journal of Biological Chemistry, vol. 277, No. 38, pp. 35035-35043.
Denoto, et al. (1981) "Human Growth Hormone DNA Sequence and mRNA Structure: Possible Alternative Splicing", Nucleic Acids Research, vol. 9, No. 15, pp. 3719-3730.
Der Maur, et al. (2002) "Direct In Vivo Screening of Intrabody Libraries Constructed on a Highly Stable Single-Chain Framework", The Journal of Biological Chemistry, vol. 277, No. 47, pp. 45075-45085.
Desplancq, et al. (1994) "Multimerization Behaviour of Single Chain Fv Variants for the Tumour-Binding Antibody B72.3,", Protein Engineering, vol. 7, No. 8, pp. 1027-1033.
Dhalluin, et al. (2005) "Structural and Biophysical Characterization of the 40 kDa Peg-Interferon-a2a and Its Individual Positional Isomers", Bioconjugate Chemistry, vol. 16, No. 3, pp. 504-517.
Di Lullo, et al. (2002) "Mapping the Ligand-Binding Sites and Disease-associated Mutations on the Most Abundant Protein in the Human, Type I Collagen", The Journal of Biological Chemistry, vol. 277, No. 6, pp. 4223-4231.
Diaz-Collier, et al. (1994) "Refold and Characterization of Recombinant Tissue Factor Pathway Inhibitor Expressed in *Escherichia coli*", Thrombosis and Haemostasis, vol. 71, No. 03, pp. 339-346.
Dietrich, et al. (2003) "ABC of Oral Bioavailability: Transporters as Gatekeepers in the Gut", Gut, vol. 52, No. 12, pp. 1788-1795.
Dolezal, et al. (2000) "Scfv Multimers of the Anti-Neuraminidase Antibody Nc10: Shortening of the Linker in Single-Chain Fv Fragment assembled in V(L) to V(H) Orientation Drives the formation of Dimers, Trimers, Tetramers and Higher Molecular Mass Multimers", Protein Engineering, vol. 13, No. 8, pp. 565-574.
Dooley, et al. (1998) "Stabilization of Antibody Fragments in Adverse Environments", Biotechnology and Applied Biochemistry, vol. 28, Part 1, pp. 77-83.
Doyle, et al. (1996) "Crystal Structures of a Complexed and Peptide-Free Membrane Protein-Binding Domain: Molecular Basis of Peptide Recognition by Pdz", Cell, vol. 85, No. 7, pp. 1067-1076.
Dumont, et al. (Mar. 29, 2012) "Prolonged Activity of a Recombinant Factor VIII-Fc Fusion Protein in Hemophilia A Mice and Dogs", Blood, vol. 119, No. 13, pp. 3024-3030.
Dumoulin, et al. (Mar. 2002) "Single-Domain Antibody Fragments With High Conformational Stability", Protein Science, vol. 11, No. 3, pp. 500-515.
Dutton, et al. (2002) "A New Level of Conotoxin Diversity, A Non-Native Disulfide Bond Connectivity in Alpha-Conotoxin Aulb Reduces Structural Definition But increases Biological Activity", The Journal of Biological Chemistry, vol. 277, No. 50, pp. 48849-48857.
Dyson, et al. (2004) "Production of Soluble Mammalian Proteins in *Escherichia coli*: Identification of Protein Features That Correlate With Successful Expression", BMC Biotechnology, vol. 4, No. 32.
Eaton, et al. (Dec. 1986) "Construction and Characterization of an Active Factor VIII Variant Lacking the Central One-Third of the Molecule", Biochemistry, vol. 25, No. 26, pp. 8343-8347.
European Search Report and opinion for European Application No. 08795371, dated Jan. 27, 2011, 5 Pages.
Extended European Search Report received for European Patent Application No. 06804210, dated Feb. 4, 2010, 9 Pages.
Extended European Search Report received for European Patent Application No. 07752549.1, 8 Pages.
Extended European Search Report received for European Patent Application No. 07752636.6, dated Mar. 26, 2009, 8 Pages.
Extended European Search Report received for European Patent Application No. 17155615.2, dated Jun. 19, 2017, 5 Pages.
Fair, et al. (1984) "Human Hepatoma Cells Secrete Single Chain Factor X, Prothrombin, and Antithrombin III", Blood, vol. 64, No. 1, pp. 194-204.
Fajloun, et al. (2000) "Maurotoxin Versus Pi1/Hstx1 Scorpion Toxins", The Journal of Biological Chemistry, vol. 275, No. 50, American Society for Biochemistry and Molecular Biology, pp. 39394-39402.
Fang, et al. (2007) "The Protein Structure and Effect of Factor VIII", Thrombosis Research, vol. 119, No. 1, pp. 1-13.
Fares, et al. (1992) "Design of a Long-Acting Follitropin Agonist by Fusing the C-Terminal Sequence of the Chorionic Gonadotropin Beta Subunit to the Follitropin Beta Subunit", Proceedings of the National Academy of Sciences, vol. 89, No. 10, pp. 4304-4308.
Felici, et al. (1991) "Selection of Antibody Ligands From a Large Library of Oligopeptides Expressed on a Multivalent Exposition Vector", Journal of Molecular Biology, vol. 222, No. 2, pp. 301-310.
Fisher, et al. (2006) "Genetic Selection for Protein Solubility Enabled by the Folding Quality Control Feature of the Twin-Arginine Translocation Pathway", Protein Science, vol. 15, No. 3, pp. 449-458.
Fitzgerald, et al. (1995) "Interchangeability of Caenorhabditis elegans DSL Proteins and Intrinsic Signaling Activity of Their Extracellular Domains In Vivo", Development, vol. 121, No. 12, pp. 4275-4282.
Flier, et al. (Dec. 6, 2015) "2271 Prolonged Half-Life and Improved Recovery of Recombinant Factor IX-XTEN Fusion Proteins in Hemophilia B Mouse Model", Blood Coagulation and Fibrinolytic

(56) References Cited

OTHER PUBLICATIONS

Factors Program: Oral and Poster Abstracts Session: 321, Blood Coagulation and Fibrinolytic Factors: Poster II, XP002789350.
Fraczkiewicz, et al. (1998) "Exact and Efficient Analytical Calculation of the Accessible Surface Areas and Their Gradients for Macromolecules", Journal of Computational Chemistry, vol. 19, pp. 319-333.
Francis, G E. (1992) "Protein Modification and Fusion Proteins", Focus on Growth Factors, vol. 3, No. 2, Mediscript, England, pp. 4-10.
Franz, Thomas J. (1975) "Percutaneous Absorption on the Relevance of in Vitro Data", Journal of Investigative Dermatology, vol. 64, No. 3, pp. 190-195.
Frenal, et al. (2004) "Exploring Structural Features of the Interaction Between the Scorpion Toxincnerg1 and ERG $K^+$ Channels", Proteins, vol. 56, No. 2, pp. 367-375.
Friend, et al. (Dec. 15, 1999) "Phase I Study of an Engineered Aglycosylated Humanized Cd3 Antibody in Renal Transplant Rejection1", Transplantation, vol. 68, Issue 11, pp. 1632-1637.
Fulcher, et al. (1985) "Localization of Human Factor FVIII Inhibitor Epitopes to Two Polypeptide Fragments", Proceedings of the National Academy of Sciences, vol. 82, No. 22, pp. 7728-7732.
Gamez, et al. (2005) "Development of Pegylated forms of Recombinant Rhodosporidium toruloides Phenylalanine Ammonia-Lyase for the Treatment of Classical Phenylketonuria", The Journal of the American Society of Gene, Therapy 11, No. 6, pp. 986-989.
Garnier, et al. (1996) "GOR Method for Predicting Protein Secondary Structure From Amino Acid Sequence", Methods in Enzymology. vol. 266, Academic Press, pp. 540-553.
Geething, et al. (2010) "Gcg-XTEN: An Improved Glucagon Capable of Preventing Hypoglycemia Without Increasing Baseline Blood Glucose", PLoS ONE, vol. 5, No. 4, e10175 Page.
GenBank (May 7, 1993) "Transferrin [human, liver, mRNA, 2347 nt]", Accession No. S95936.1, Retrieved from: <<http://www.ncbi.nlm.nih.gov/nuccore/S95936>>, 2 pages.
GenBank Database (May 13, 2002) "*Homo sapiens* Transferrin (TF), mRNA", GenBank accession No. XM002793, Retrieved from: <<https://www.ncbi.nlm.nih.gov/nuccore/XM_002793.7?report=genbank>>, accessed on Sep. 24, 2014, 2 Pages.
GenBank Database (Jul. 16, 2001) "*Homo sapiens* Transferrin (TF), mRNA", GenBank accession No. XM039845, Retrieved from: <<https://www.ncbi.nlm.nih.gov/nuccore/XM_039845.1?report=genbank>>, 2 Pages.
GenBank Database (May 25, 2014) "*Homo sapiens* Transferrin (TF), Transcript Variant 1, mRNA", Accession No. NM001063.3, Retrieved from: <<http://www.ncbi.nlm.nih.gov/nuccore/NM_001063>>, 5 Pages.
GeneBank (2008) "*Homo sapiens* Coagulation Factor VIII, Procoagulant Component (F8), Transcript Variant 1, mRNA", Accession No. NM_000132.3, Retrieved from: <<http://www.ncbi.nlm.nih.gov/nuccore/NM_000132.3>>, 12 Pages.
George, et al. (2003) "An Analysis of Protein Domain Linkers: Their Classification and Role in Protein Folding", Protein Engineering Design, vol. 15, No. 11, pp. 871-879.
Gilkes, et al. (1991) "Domains in Microbial Beta-1, 4-Glycanases: Sequence Conservation, Function, and Enzyme Families", Microbiological Reviews, vol. 55, No. 2, pp. 303-315.
Gilles, et al. (1993) "Anti-Factor VIII Antibodies of Hemophiliac Patients Are Frequently Directed Towards Nonfunctional Determinants and Do Not Exhibit Isotypic Restriction", Blood, vol. 82, No. 8, pp. 2452-2461.
Gitschier, et al. (Nov. 22-28, 1984) "Characterization of the Human Factor VIII Gene", Nature, vol. 312, No. 5992, pp. 326-330.
Gleeson, et al. (1986) "Transformation of the Methylotrophic Yeast Hansenula polymorpha", Microbiology, vol. 132, No. 12, pp. 3459-3465.
Goeddel, et al. (1980) "Synthesis of Human Fibroblast Interferon by *E. coli*", Nucleic Acids Research, vol. 8, No. 18, pp. 4057-4074.
Gomez-Duarte, et al. (1995) "Expression of Fragment C of Tetanus Toxin Fused to a Carboxyl-Terminal Fragment of Diphtheria Toxin in *Salmonella typhi* CVD 908 Vaccine Strain", Vaccine, vol. 13, No. 16, pp. 1596-1602.
Gouw, et al. (Nov. 2009) "The Multifactorial Etiology of Inhibitor Development in Hemophilia: Genetics and Environment", Seminars in Thrombosis and Hemostasis, vol. 35, No. 8, pp. 723-734.
Graff, et al. (2003) "Theoretical Analysis of Antibody Targeting of Tumor Spheroids: Importance of Dosage for Penetration, And Affinity for Retention", Cancer Research, vol. 63, No. 6, pp. 1288-1296.
Graham, et al. (Apr. 1, 1973) "A New Technique for the Assay of Infectivity of Human Adenovirus 5 DNA", Virology, vol. 52, No. 2, pp. 456-467.
Graham, et al. (Jul. 1, 1977) "Characteristics of a Human Cell Line Transformed by DNA From Human Adenovirus Type 5", Journal of General Virology, vol. 36, No. 1, pp. 59-72.
Graw, et al. (Jun. 2005) "Haemophilia A: From Mutation Analysis to New Therapies", Nature Reviews Genetics, vol. 6, No. 6, pp. 488-501.
Gray, et al. (1988) "Peptide Toxins from Venomous Conus Snails", Annual Review of Biochemistry, vol. 57, pp. 665-700.
Greenwald, et al. (2003) "Effective Drug Delivery by PEGylated Drug Conjugates", Advanced Drug Delivery Reviews, vol. 55, No. 2, pp. 217-250.
Gruppo, et al. (May 2003) "Comparative Effectiveness of Full-Length and B-Domain Deleted Factor VIII for Prophylaxis-A Meta-Analysis", Haemophilia, vol. 9, No. 3, pp. 251-260.
Guncar, et al. (1999) "Crystal Structure of MHC Class II-associated P41 li Fragment Bound to Cathepsin L Reveals the Structural Basis for Differentiation Between Cathepsins L and S", The EMBO Journal, vol. 18, No. 4, pp. 793-803.
Guo, et al. (2005) "Crystal Structure of the Cysteine-Rich Secretory Protein Stecrisp Reveals That the Cysteine-Rich Domain Has A $K^{30}$ Channel inhibitor-Like Fold", The Journal of Biological Chemistry, vol. 280, No. 13, pp. 12405-12412.
Gupta, et al. (2004) "Classification of Disulfide Patterns and Its Relationship to Protein Structure and Function", Protein Science: a Publication of the Protein Society, vol. 13, No. 8, pp. 2045-2058.
Gustafsson, et al. (2004) "Codon Bias and Heterologous Protein Expression", Trends in Biotechnology, vol. 22, No. 7, pp. 346-353.
Hamers-Casterman, et al. (Jun. 3, 1993) "Naturally Occurring Antibodies Devoid of Light Chains", Nature, vol. 363, No. 6428, pp. 446-448.
Hammer, J. (1995) "New Methods to Predict MHC-Binding Sequences Within Protein Antigens", Current Opinion in Immunology, vol. 7, No. 2, pp. 263-269.
Harris, et al. (2003) "Effect of Pegylation on Pharmaceuticals", Nature Reviews Drug Discovery, vol. 2, No. 3, pp. 214-221.
Harris, et al. (2000) "Rapid and General Profiling of Protease Specificity by Using Combinatorial Fluorogenic Substrate Libraries", Proceedings of the National Academy of Sciences, vol. 97, No. 14, pp. 7754-7759.
Healey, et al. (Dec. 1, 1996) "The cDNA and Derived Amino Acid Sequence of Porcine Factor VIII", Blood, vol. 88, No. 11, pp. 4209-4214.
Hedner, et al. (1983) "Use of Human Factor VIIa in the Treatment of Two Hemophilia A Patients With High-Titer Inhibitors", The Journal of Clinical Investigation vol. 71, No. 6, pp. 1836-1841.
Hennighausen, et al. (1982) "Mouse Whey Acidic Protein is a Novel Member of the Family of Four-Disulfide Core' Proteins", Nucleic Acids Research, vol. 10, No. 8, pp. 2677-2684.
Hermeling, et al. (2004) "Structure-Immunogenicity Relationships of Therapeutic Proteins", Pharmaceutical Research, vol. 21, No. 6, pp. 897-903.
Higgins, et al. (1995) "Polyclonal and Clonal Analysis of Human CD4+ T-Lymphocyte Responses to Nut Extracts", Immunology, vol. 84, No. 1, pp. 91-97.
Hill, et al. (2000) "Conotoxin TVIIA, A Novel Peptide from the Venom of Conus tulipa 1", European Journal of Biochemistry/FEBS, vol. 267, No. 15, pp. 4642-4648.

(56) References Cited

OTHER PUBLICATIONS

Hinds, et al. (2005) "PEGylated Insulin in PLGA Microparticles. In Vivo and In Vitro Analysis", Journal of Controlled Release, vol. 104, No. 3, pp. 447-460.
Hirel, et al. (1989) "Extent of N-Terminal Methionine Excision from *Escherichia coli* Proteins is Governed by the Side-Chain Length of the Penultimate Amino Acid", Proceedings of the National Academy of Sciences of the United States of America, vol. 86, No. 21, pp. 8247-8251.
Ho, et al.(Apr. 15, 1989) "Site-Directed Mutagenesis by Overlap Extension Using the Polymerase Chain Reaction", Gene, vol. 77, No. 1, pp. 51-59.
Hoeben, et al. (1990) "Expression of Functional Factor Viii in Primary Human Skin Fibroblasts After Retrovirus-Mediated Gene Transfer", Journal of Biological Chemistry, vol. 265, No. 13, pp. 7318-7323.
Hogg, Philip J. (2003) "Disulfide Bonds as Switches for Protein Function", Trends in Biochemical Sciences, vol. 28, No. 4, pp. 210-214.
Holt, et al. (May 2008) "Anti-Serum Albumin Domain Antibodies for Extending the Half-Lives of Short Lived Drugs", Protein Engineering, Design and Selection, vol. 21, No. 5, pp. 283-288.
Hopp, et al. (1981) "Prediction of Protein Antigenic Determinants from Amino Acid Sequences", Proceedings of the National Academy of Sciences, vol. 78, No. 6, pp. 3824-3828.
Horton, et al. (1993) "Gene Splicing by Overlap Extension", Methods in Enzymology, vol. 217, pp. 270-279.
Hsu, et al. (2000) "Vaccination Against Gonadotropin-Releasing Hormone (Gnrh) Using Toxin Receptor-Binding Domain-Conjugated Gnrh Repeats", Cancer Research, vol. 60, No. 14, pp. 3701-3705.
Hudson, et al. (1999) "High Avidity Scfv Multimers; Diabodies and Triabodies", Journal of Immunological Methods, vol. 231, No. 1-2, pp. 177-189.
Huston, et al. (Aug. 1988) "Protein Engineering of Antibody Binding Sites: Recovery of Specific Activity in an Anti-Digoxin Single-Chain Fv Analogue Produced in *Escherichia coli*", Proceedings of the National Academy of Sciences of the United States of America, vol. 85, No. 16, pp. 5879-5883.
International Search Report and Written Opinion received for PCT Patent Application No. PCT/US2006/037713, dated Jan. 17, 2008, 8 Pages.
International Search Report and Written Opinion received for PCT Patent Application No. PCT/US2007/05857, dated Sep. 26, 2007, 8 Pages.
International Search Report and Written Opinion received for PCT Patent Application No. PCT/US2007/05952, dated Dec. 26, 2007, 9 Pages.
International Search Report and Written Opinion received for PCT Patent Application No. PCT/US2008/09787, dated Mar. 16, 2009, 9 Pages.
International Search Report and Written Opinion received for PCT Patent Application No. PCT/US2010/02148, dated Dec. 1, 2010, 10 Pages.
International Search Report and Written Opinion received for PCT Patent Application No. PCT/US2010/23106, dated Apr. 20, 2010, 9 Pages.
International Search Report and Written Opinion received for PCT Patent Application No. PCT/US2010/37855, dated Oct. 29,2010, 9 Pages.
International Search Report and Written Opinion received for PCT Patent Application No. PCT/US2011/043568, dated Nov. 25, 2011, 10 Pages.
International Search Report and Written Opinion received for PCT Patent Application No. PCT/US2012/46326, dated Jan. 25, 2013, 17 Pages.
International Search Report and Written Opinion received for PCT Patent Application No. PCT/US2013/021330, dated Apr. 29, 2013, 8 Pages.
International Search Report and Written Opinion received for PCT Patent Application No. PCT/US2013/049989, dated Dec. 16, 2013, 14 Pages.
International Search Report and Written Opinion received for PCT Patent Application No. PCT/US2014/044731, dated Nov. 4, 2014, 9 Pages.
International Search Report and Written Opinion received for PCT Patent Application No. PCT/US2014/051144, dated Feb. 10, 2015,14 Pages.
International Search Report and Written Opinion received for PCT Patent Application No. PCT/US2015/010738, dated May 15, 2015, 13 Pages.
International Search Report and Written Opinion received for PCT Patent Application No. PCT/US2010/02147, dated Dec. 20, 2010, 9 Pages.
International Search Report and Written Opinion received for PCT Patent Application No. PCT/US2010/061590, dated Jul. 12, 2011, 14 Pages.
International Search Report and Written Opinion received for PCT Patent Application No. PCT/US2011/48517, dated Mar. 14, 2012.
International Search Report and Written Opinion received for PCT Patent Application no. PCT/US2013/026521, dated Apr. 24, 2013, 11 Pages.
International Search Report and Written Opinion received for PCT Patent Application no. PCT/US2014/040370, dated Jan. 9, 2015, 13 Pages.
International Search Report and Written Opinion received for PCT Patent Application No. PCT/US2016/045401, dated Oct. 28, 2016, 9 Pages.
Israel, et al. (Sep. 1997) "Expression of the Neonatal Fc Receptor, FcRn, On Human Intestinal Epithelial Cells", Immunology, vol. 92, No. 1, pp. 69-74.
Iwasaki, et al. (1997) "Solution Structure of Midkine, A New Heparin-Binding Growth Factor", The the EMBO Journal, vol. 16, No. 23, pp. 6936-6946.
Jackson, et al. (2007) "The Characterization of Paclitaxel-Loaded Micro Spheres Manufactured from Blends of Poly (Lactic-Co-Glycolic Acid) (PLGA) and Low Molecular Weight Diblock Copolymers", International Journal of Pharmaceutics, vol. 342, No. 1-2, pp. 6-17.
Jacquemin, et al. (2000) "A Human Antibody Directed to the Factor VIII C1 Domain Inhibits Factor VIII Cofactor Activity and Binding to Von Willebrand Factor", Blood, vol. 95, No. 1, pp. 156-163.
Johansson, et al. (2007) "Modifications Increasing the Efficacy of Recombinant Vaccines; Marked Increase in Antibody Titers with Moderately Repetitive Variants of a Therapeutic Allergy Vaccine", Vaccine, vol. 25, No. 9, pp. 1676-1682.
Jonassen, et al. (1995) "Finding Flexible Patterns in Unaligned Protein Sequences", Protein Science, vol. 4, No. 8, pp. 1587-1595.
Jones, et al. (May 29, 1986) "Replacing the Complementarity-Determining Regions in a Human Antibody with Those from a Mouse", Nature, vol. 321, No. 6069, pp. 522-525.
Jonsson, et al. (1993) "Quantitative Sequence-Activity Models (QSAM)-Tools for Sequence Design", Nucleic Acids Research, vol. 21, No. 3, pp. 733-739.
Joosten, et al. (2011) "A Series of PDB Related Databases for Everyday Needs", Nucleic Acids D Research, vol. 39, pp. D411-D419.
Jung, et al. (1997) "Improving In Vivo Folding and Stability of a Single-Chain Fv Antibody Fragment by Loop Grafting", Protein Engineering, vol. 10, No. 8, pp. 959-966.
Kabsch, et al. (1983) "Dictionary of Protein Secondary Structure: Pattern Recognition of Hydrogen-Bonded and Geometrical Features", Biopolymers, vol. 22, No. 12, pp. 2577-2637.
Kamikubo, et al. (2004) "Disulfide Bonding Arrangements in Active forms of the Somatomedin B Domain of Human Vitronectin", Biochemistry, vol. 43, No. 21, pp. 6519-6534.
Kasuda, et al. (Aug. 2008) "Establishment of Embryonic Stem Cells Secreting Human Factor VIII for Cell-Based Treatment of Hemophilia A", Journal of Thrombosis and Haemostasis, vol. 6, No. 8, pp. 1352-1359.

(56) References Cited

OTHER PUBLICATIONS

Kaufman, et al. (1982) "Construction of a Modular Dihydrofolate Reductase cDNA Gene: Analysis of Signals Utilized for Efficient Expression", Molecular and Cellular Biology, vol. 2, No. 11, pp. 1304-1319.

Kazatchkine, et al. (1980) "Circulating Immune Complexes Containing Anti-VIII Antibodies in Multi-Transfused Patients with Haemophilia A", American Journal of Clinical and Experimental Immunology, vol. 39, No. 2, pp. 315-320.

Kelly, et al. (2003) "Isolation of a Colon Tumor Specific Binding Peptide Using Phage Display Selection", Neoplasia, vol. 5, No. 5, pp. 437-444.

Kemball-Cook, et al. (1998) "The factor VIII Structure and Mutation Resource Site: HAMSTeRS Version 4", Nucleic Acids Research, vol. 26, No. 1, pp. 216-219.

Khan, et al. (1998) "Solubilization of Recombinant Ovine Growth Hormone with Retention of Native-Like Secondary Structure and Its Refolding from the Inclusion Bodies of *Escherichia coli*", Biotechnology Progress, vol. 14, No. 5, pp. 722-728.

Kim, et al. (1995) "Three-Dimensional Solution Structure of the Calcium Channel Antagonist Omega-Agatoxin IVA: Consensus Molecular Folding of Calcium Channel Blockers", Journal of Molecular Biology, vol. 250, No. 5, pp. 659-671.

Kim, et al. (Sep. 2010) "Transferrin Fusion Technology: A Novel Approach to Prolonging Biological Half-Life of Insulinotropic Peptides", Journal of Pharmacology and Experimental Therapeutics, vol. 334, No. 3, pp. 682-692.

Kimble, et al. (1997) "The Lin-12/Notch Signaling Pathway and Its Regulation", Annual Review of Cell and Developmental Biology, pp. 333-361.

Kisiel, et al. (1983) "Enzymological Aspects of Blood Coagulation", Behring Institute Mitteilungen, vol. 73, pp. 29-42.

Kissel, et al. (2002) "ABA-Triblock Copolymers from Biodegradable Polyester A-Blocks and Hydrophilic Poly (Ethylene Oxide) B-Blocks as a Candidate for In Situ Forming Hydrogel Delivery Systems for Proteins", Advanced Drug Delivery Reviews, vol. 54, No. 1, pp. 99-134.

Klitgaard, et al. (2008) "Overview of the Human Pharmacokinetics of Recombinant Activated Factor VII", British Journal of Clinical Pharmacology, vol. 65, No. 1, pp. 3-11.

Kobayashi, et al. (Feb. 2002) "FcRn-Mediated Transcytosis of Immunoglobulin G in Human Renal Proximal Tubular Epithelial Cells", American Journal of Physiology-Renal Physiology, vol. 282, No. 2, pp. F358-F365.

Kohn, et al. (2004) "Random-Coil Behavior and the Dimensions of Chemically Unfolded Proteins", Proceedings of the National Academy of Sciences, vol. 101, No. 34, pp. 12491-14296.

Koide, et al. (1998) "The Fibronectin Type III Domain as a Scaffold for Novel Binding Proteins", Journal of Molecular Biology, vol. 284, No. 4, pp. 1141-1151.

Konig, et al. (Sep. 1, 1998) "Use of an Albumin-Binding Domain for the Selective Immobilisation of Recombinant Capture Antibody Fragments on ELISA Plates", Journal of Immunological Methods, vol. 218, No. 1-2, pp. 73-83.

Kortt, et al. (1997) "Single-Chain Fv Fragments of Anti-Neuraminidase Antibody Nc10 Containing Five—and Ten-Residue Linkers Form Dimers and with Zero-Residue Linker a Trimer", Protein Engineering, vol. 10, No. 4, pp. 423-433.

Kou, et al. (2007) "Preparation and Characterization of Recombinant Protein ScFv(CD11c)-TRP2 for Tumor therapy from inclusion Bodies in *Escherichia coli*", Protein Expression and Purification, vol. 52, No. 1, pp. 131-138.

Kratzner, et al. (2005) "Structure of Ecballium elaterium Trypsin Inhibitor II(EETI-II): A Rigid Molecular Scaffold", Acta Crystallographica, vol. 61, Part 9, pp. 1255-1262.

Kraulis, et al. (Jan. 8, 1996) "The Serum Albumin-Binding Domain of Streptococcal Protein G Is a Three-Helical Bundle: A Heteronuclear NMR Study", FEBS Letters, vol. 378, Issue 2, pp. 190-194.

Kristensen, et al. (1998) "Proteolytic Selection for Protein Folding Using Filamentous Bacteriophages", Folding & Design, vol. 3, No. 5, pp. 321-328.

Kubetzko, et al. (Nov. 1, 2005) "Protein PEGylation Decreases Observed Target Association Rates Via a Dual Blocking Mechanism", Molecular Pharmacology vol. 68, No. 5, The American Society for Pharmacology and Experimental Therapeutics, United States, pp. 1439-1454.

Kulman, et al. (2007) "A Versatile System for Site-Specific Enzymatic Biotinylation and Regulated Expression of Proteins in Cultured Mammalian Cells", Protein Expression and Purification, vol. 52, No. 2, pp. 320-328.

Kurachi, et al. (1982) "Isolation and Characterization of a cDNA Coding for Human Factor IX", Proceedings of the National Academy of Sciences, pp. 6461-6464.

Kwon, et al. (Feb. 2004) "Biodegradable Triblock Copolymer Microspheres Based on Thermosensitive Sol-Gel Transition", Pharmaceutical Research, vol. 21, Issue 2, pp. 339-343.

Lane, et al. (Jan. 3, 2006) "Influence of Post-Emulsification Drying Processes on the Microencapsulation of Human Serum Albumin", International Journal of Pharmaceutics, vol. 307, No. 1, pp. 16-22.

Langner, et al. (Apr. 1988) "Synthesis of Biologically Active Deletion Mutants of Human Factor VIII:C", Behring Institute Mitteilungen, No. 82, pp. 16-25.

Lapatto, et al. "X-ray Structure of Antistasin at 1.9 Å Resolution and Its Modelled Complex with Blood Coagulation Factor Xa", The EMBO Journal vol. 16, No. 17, Wiley Blackwell, England, pp. 5151-5161.

Larrick, et al. (1989) "Rapid Cloning of Rearranged Immunoglobulin Genes from Human Hybridoma Cells using Mixed Primers and the Polymerase Chain Reaction", Biochemical and Biophysical Research Communications, vol. 160, No. 3, pp. 1250-1256.

Lauber, et al. (Apr. 18, 2003) "Homologous Proteins with Different Folds: The Three-Dimensional Structures of Domains 1 and 6 of the Multiple Kazal-Type inhibitor Lekti", Journal of Molecular Biology, vol. 328, No. 1, pp. 205-219.

Lavigne-Lissalde, et al. (Oct. 2009) "Characteristics, Mechanisms of Action, and Epitope Mapping of Antifactor VIII Antibodies", Clinical Reviews in Allergy & Immunology, vol. 37, No. 2, pp. 67-79.

Le Gall, et al. (Jun. 1999) "Di-, Tri- and Tetrameric Single Chain Fv Antibody Fragments Against Human Cd19: Effect of Valency on Cell Binding", FEBS letters, vol. 453, No. 1-2, pp. 164-168.

Lee, et al. "A recombinant human G-CSF/GM-CSF fusion protein from *E. coli* showing colony stimulating activity on human bone marrow cells", Biotechnology Letters, vol. 25, No. 3, pp. 205-211.

Lee, et al. (Dec. 1999) "Pharmacokinetics of Recombinant Factor VIII (Recombinate) Using One-Stage Clotting and Chromogenic Factor VIII Assay", Journal of Thrombosis and Haemostasis, vol. 82, No. 6, pp. 1644-1647.

Lee, Vincent H. (2001) "Mucosal Drug Delivery", Journal of the National Cancer Institute Monographs, vol. 29, pp. 41-44.

Lenting, et al. (Jul. 2007) "Clearance Mechanisms of von Willebrand Factor and Factor VIII", Journal of Thrombosis and Haemostasis, vol. 5, No. 7, pp. 1353-1360.

Lenting, et al. (May 2010) "The disappearing act of factor VIII", Haemophilia, vol. 16, No. 102, pp. 6-15.

Lenting, et al. (Dec. 1, 1998) "The Life Cycle of Coagulation Factor VIII in View of its Structure and Function", Blood, vol. 92, No. 11, pp. 3983-3996.

Lenting, et al. (Aug. 20, 1999) "The Light Chain of Factor VIII Comprises a Binding Site for Low Density Lipoprotein Receptor-Related Protein", The Journal of Biological Chemistry, vol. 274, No. 34, pp. 23734-23739.

Leong, et al. (Nov. 2001) "Adapting Pharmacokinetic Properties of a Humanized Anti-Interleukin-8 Antibody for Therapeutic Applications Using Site-Specific Pegylation", Cytokine, vol. 16, Issue 3, pp. 106-119.

Leong, et al. (Feb. 4, 2003) "Optimized Expression and Specific Activity of 11-12 by Directed Molecular Evolution", Proceedings of the National Academy of Sciences of the United States of America, vol. 100, No. 3, pp. 1163-1168.

(56) References Cited

OTHER PUBLICATIONS

Levitt, et al. (1976) "A Simplified Representation of Protein Conformations for Rapid Simulation of Protein Folding", Journal of Molecular Biology, vol. 104, No. 1, pp. 59-107.
Levy, et al. (2007) "Isolation of Trans-Acting Genes That Enhance Soluble Expression of Scfv Antibodies in the E", Journal of Immunological Methods, vol. 321, No. 1-2, pp. 164-173.
Leyte, et al. (Jan. 15, 1991) "Sulfation of Tyr1680 of Human Blood Coagulation Factor VIII Is Essential for the Interaction of Factor VIII With von Willebrand Factor", Journal of Biological Chemistry, vol. 266, No. 2, pp. 740-746.
Leyte, et al. (1989) "The Interaction Between Human Blood-Coagulation Factor VIII and Von Willebrand Factor: Characterization of a High-Affinity Binding Site on Factor VIII", Biochemical, Journal 257, No. 3, pp. 679-683.
Li, et al. (May 2002) "The Role of the Transferrin-Transferrin-Receptor System in Drug Delivery and Targeting", Trends in Pharmacological Sciences, vol. 23, No. 5, pp. 206-209.
Lillicrap, D. (2008) "Extending Half-Life in Coagulation Factors: Where Do We Stand?", Thrombosis Research, vol. 122, Supplement 4, pp. S2-S8.
Lin, et al. (1997) "A Coagulation Factor IX-Deficient Mouse Model for Human Hemophilia B", Blood, vol. 90, Issue 10, pp. 3962-3966.
Linhult, et al. (Feb. 2002) "Mutational Analysis of the Interaction Between Albumin-Binding Domain from Streptococcal Protein G and Human Serum Albumin", Protein Science, vol. 11, No. 2, pp. 206-213.
Lippi, et al. (2007) "Diagnostic Approach to Inherited Bleeding Disorders", Clinical Chemistry and Laboratory Medicine, vol. 45, No. 1, pp. 2-12.
Lippi, et al. (2006) "Preanalytical Variability: The Dark Side of the Moon in Laboratory Testing", Clinical Chemistry and Laboratory Medicine, vol. 44, No. 4, pp. 358-365.
Liu, et al. (2007) "Evaluation of PEG-FVIII Molecules with Prolonged Half-lives in a Murine FVIII Dependent Bleeding Model", Journal of Thrombosis and Haemostasis, vol. 9, Suppl. 2: P-M-035, ISTH Meeting, Poster: Factor VIII, Factor V, Exhibition Area, International Society on Thrombosis and Haemostasis, United States, 1 page.
Liu, et al. (2011) "Recombinant FVIII Fe fusion protein is fully active in treating acute injury and demonstrates prolonged prophylactic efficacy in hemophilia a mice", Journal of Thrombosis and Haemostasis vol. 9, Suppl. 2: P-WE-131, ISTH Meeting, International Society on Thrombosis and Haemostasis, United States.
Liu, et al. (1997) "The Human Beta-Defensin-1 and Alpha-Defensins are Encoded by Adjacent Genes: Two Peptide Families with Differing Disulfide Topology Share a Common Ancestry", Genomics, vol. 43, No. 3, pp. 316-320.
Logan, et al. (Jun. 1984) "Adenovirus Tripartite Leader Sequence Enhances Translation of mRNAs Late After Infection", Proceedings of the National Academy of Sciences, vol. 81, No. 12, pp. 3655-3659.
Lollar, et al. (Jun. 1994) "Inhibition of Human Factor VIIIa by Anti-A2 Subunit Antibodies", The Journal of Clinical Investigation, vol. 93, No. 6, pp. 2497-2504.
London, et al. (Jul. 20, 2000) "Zymogen Factor IX Potentiates Factor IXa-Catalyzed Factor X Activation", Biochemistry, vol. 39, No. 32, pp. 9850-9858.
Lowman, et al. (Nov. 12, 1991) "Selecting High-Affinity Binding Proteins by Monovalent Phage Display", Biochemistry, vol. 30, No. 45, pp. 10832-10838.
Loyter, et al. (Jan. 1982) "Mechanisms of DNA Uptake by Mammalian Cells: Fate of Exogenously Added DNA Monitored by the Use of Fluorescent Dyes", Proceedings of the National Academy of Sciences, vol. 79, No. 2, pp. 422-426.
Lozier, et al. (2002) "The Chapel Hill Hemophilia A Dog Colony Exhibits a Factor VIII Gene Inversion", Proceedings of the National Academy of Sciences USA, vol. 99, No. 20, pp. 12991-12996.
Mackett, et al. (Mar. 1984) "General Method for Production and Selection of Infectious Vaccinia Virus Recombinants Expressing Foreign Genes", Journal of Virology, vol. 49, No. 3, pp. 857-864.
Mackett, et al. (Dec. 1982) "Vaccinia Virus: A Selectable Eukaryotic Cloning and Expression Vector", Proceedings of the National Academy of Sciences of the United States of America, vol. 79, No. 23, pp. 7415-7419.
Maggio, Edward (Jul. 2006) "Intravail™: Highly Effective Intranasal Delivery of Peptide and Protein Drugs", Expert Opinion on Drug Delivery, vol. 3, No. 4, pp. 529-539.
Malik, et al. (Sep. 1992) "Polyethylene Glycol (PEG)-Modified Granulocyte-Macrophage Colony-Stimulating Factor (GM-CSF) With Conserved Biological Activity", Experimental Hematology, vol. 20, No. 8, pp. 1028-1035.
Mannucci, et al. (Jun. 1, 2001) "The Hemophilias-From Royal Genes to Gene Therapy", New England Journal of Medicine, vol. 344, No. 23, pp. 1773-1779.
Marshall, et al. (Aug. 25, 2004) "Enhancing the Activity of a Beta-Helical Antifreeze Protein by the Engineered Addition of Coils", Biochemistry, vol. 43, No. 37, pp. 11637-11646.
Martin, et al. (Apr. 1999) "Evaluation of a Novel ELISA Screening Test for Detection of Factor VIII Inhibitory Antibodies in Haemophiliacs", Clinical & Laboratory Haematology, vol. 21, No. 2, pp. 125-128.
Martin, et al. (Jan. 2003) "Rational Design of a CD4 Mimic that Inhibits HIV-1 Entry and Exposes Cryptic Neutralization Epitopes", Nature Biotechnology, vol. 21, No. 1, pp. 71-76.
Martineau, et al. (Jul. 3, 1998) "Expression of an Antibody Fragment at High Levels in the Bacterial Cytoplasm", Journal of Molecular Biology, vol. 280, No. 1, pp. 117-127.
Martinelli, et al. (2010) "Polymorphisms at LDLR Locus May Be Associated with Coronary Artery Disease Through Modulation of Coagulation Factor VIII Activity and Independently from Lipid Profile", Blood, vol. 116, pp. 5688-5697.
Matsumoto, et al. (2006) "The Measurement of Low Levels of Factor VIII or Factor IX in Hemophilia A and Hemophilia B Plasma by Clot Waveform Analysis and Thrombin Generation Assay", Journal of Thrombosis and Haemostasis, vol. 4, No. 2, pp. 377-384.
McCue, et al. (Nov. 6, 2009) "Application of a Novel Affinity Adsorbent for the Capture and Purification of Recombinant Factor VIII Compounds", Journal of Chromatography A, vol. 1216, No. 45, pp. 7824-7830.
McDonald, et al. (Sep. 15, 2002) "Significance of Blood Vessel Leakiness in Cancer", Cancer Research, vol. 62, No. 18, pp. 5381-5385.
McKnight, et al. (Aug. 1, 1985) "Identification and Molecular Analysis of a Third Aspergillus Nidulans Alcohol Dehydrogenase Gene", The EMBO Journal, vol. 4, No. 8, pp. 2093-2099.
Meeks, et al. (Dec. 15, 2007) "Antihuman Factor VIII C2 Domain Antibodies in Hemophilia a Mice Recognize a Functionally Complex Continuous Spectrum of Epitopes Dominated by Inhibitors of Factor VIII Activation", Blood, vol. 110, No. 13, pp. 4234-4242.
Meeks, et al. (Apr. 2009) "Non-Classical Anti-Factor VIII C2 Domain Antibodies are Pathogenic in a Murine In vivo Bleeding Model", Journal of Thrombosis and Haemostasis, vol. 7, No. 4, pp. 658-664.
Mei, et al. (Oct. 2006) "Expression of Human Coagulation Factor VIII in a Human Hybrid Cell Line, HKB11", Molecular Biotechnology, vol. 34, No. 2, Humana Press Inc., pp. 165-178.
Mei, et al. (Jul. 15, 2010) "Rational Design of a Fully Active, Long-Acting PEGylated Factor VIII for Hemophilia A Treatment", Blood, vol. 116, No. 2, pp. 270-279.
Meier, et al. (Jul. 2, 2004) "Determination of a High-Precision NMR Structure of the Minicollagen Cysteine Rich Domain from Hydra and Characterization of Its Disulfide Bond formation", FEBS Letters, vol. 569, No. 1-3, pp. 112-116.
Meulien, et al. (1988) "A New Recombinant Procoagulant Protein Derived from the cDNA Encoding Human Factor VIII", Protein Engineering, Design and Selection, vol. 2, No. 4, pp. 301-306.
Miao, et al. (May 1, 2004) "Bioengineering of Coagulation Factor Viii for Improved Secretion", Blood, vol. 103, No. 9, pp. 3412-3419.

(56) References Cited

OTHER PUBLICATIONS

Miljanich, et al. (Jan. 2004) "Ziconotide: Neuronal Calcium Channel Blocker for Treating Severe Chronic Pain", Current Medicinal Chemistry, vol. 11, No. 23, pp. 3029-3040.
Misenheimer, et al. (Dec. 16, 2005) "Biophysical Characterization of the Signature Domains of Thrombospondin-4 and Thrombospondin-2*", Journal of Biological Chemistry, vol. 280, No. 40, pp. 41229-41235.
Misenheimer, et al. (Oct. 4, 2001) "Disulfide Connectivity of Recombinant C-terminal Region of Human Thrombospondin 2", The Journal of Biological Chemistry, vol. 276, No. 49, pp. 45882-45887.
Mize, et al. (2008) "Regulated Expression of Active Biotinylated G-Protein Coupled Receptors in Mammalian Cells", Protein Expression and Purification, vol. 57, No. 2, pp. 280-289.
Morfini, Massimo (2008) "Secondary Prophylaxis with Factor IX Concentrates: Continuous Infusion", Blood Transfusion, vol. 6, Supplement 2, pp. s21-s25.
Morpurgo, et al. (Jan. 1996) "Covalent Modification of Mushroom Tyrosinase With Different Amphiphic Polymers for Pharmaceutical and Biocatalysis Applications", Applied Biochemistry and Biotechnology, vol. 56, No. 1, pp. 59-72.
Mount, et al. (Apr. 15, 2002) "Sustained Phenotypic Correction of Hemophilia B Dogs with a Factor IX Null Mutation by Liver-Directed Gene Therapy", Blood, vol. 99, No. 8, pp. 2670-2676.
Mrsny, et al. (Feb. 15, 2002) "Bacterial Toxins as Tools for Mucosal Vaccination", Drug Discovery Today, vol. 7, Issue 4, pp. 247-258.
Muller, et al. (Aug. 2007) "Recombinant Bispecific Antibodies for Cellular Cancer Immunotherapy", Current opinion in molecular therapeutics, vol. 9, No. 4, pp. 319-326.
Murtuza, et al. (Mar. 23, 2004) "Transplantation of Skeletal Myoblasts Secreting an IL-1 Inhibitor Modulates Adverse Remodeling in Infarcted Murine Myocardium", Proceedings of the National Academy of Sciences of the United States of America, vol. 101, No. 12, pp. 4216-4221.
Narita, et al. (1998) "The Low-Density Lipoprotein Receptor-Related Protein (LRP) Mediates Clearance of Coagulation Factor Xa In Vivo", Blood, vol. 91, No. 2, pp. 555-560.
Narmoneva, et al. (Aug. 2005) "Self-Assembling Short Oligopeptides and the Promotion of Angiogenesis", Biomaterials, vol. 26, Issue 23, pp. 4837-4846.
NCBI "Probable Electron Transfer Flavoprotein Subunit Alpha, Mitochondrial [Galendromus Occidentalis]", NCBI Reference Sequence: XP_003746909.1 Retrieved From: <<https://www.ncbi.nlm.nih.gov/protein/391345263?report=genbank&log$=protalign&blast_rank=1&RID=3ERSOM7501R>>, 3 pages.
Needleman, et al. (Mar. 1970) "A General Method Applicable to the Search for Similarities in the Amino Acid Sequence of Two Proteins", Journal of Molecular Biology, vol. 48, No. 3, pp. 443-453.
Neumann, et al. (1982) "Gene Transfer Into Mouse Lyoma Cells by Electroporation in High Electric Fields", The EMBO Journal, vol. 1, No. 7, pp. 841-845.
Ngo, et al. (Apr. 2008) "Crystal Structure of Human Factor VIII: Implications for the Formation of the Factor IXa-Factor VIIIa Complex", Structure, vol. 16, No. 4, pp. 597-606.
Nielsen, et al. (Jul. 2003) "Di/Tri-Peptide Transporters as Drug Delivery Targets: Regulation of Transport Under Physiological and Patho-Physiological Conditions", Current Drug Targets, vol. 4, Issue 5, pp. 373-388.
Nielsen, et al. (Jul. 26, 2002) "Solution Structure of μ-Conotoxin PIIIA, a Preferential Inhibitor of Persistent Tetrodotoxin-sensitive Sodium Channels", The Journal of Biological Chemistry, vol. 277, pp. 27247-27255.
Noe, Dennis A. (Nov.-Dec. 1996) "A Mathematical Model of Coagulation Factor VIII Kinetics", Haemostasis, vol. 26, No. 6, pp. 289-303.
Nord, et al. (Aug. 1997) "Binding Proteins Selected from Combinatorial Libraries of an α-Helical Bacterial Receptor Domain", Nature Biotechnology, vol. 15, Issue 8, pp. 772-777.

O'Brien, et al. (Apr. 15, 1990) "Purification and characterization of factor VIII 372-Cys: A hypofunctional cofactor from a patient with moderately severe hemophilia A", Blood, vol. 75, No. 8, pp. 1664-1672.
O'Connell, et al. (Aug. 2, 2002) "Phage versus Phagemid Libraries for Generation of Human Monoclonal Antibodies", Journal of Molecular Biology, vol. 321, Issue 1, pp. 49-56.
O'Leary, et al. (Jan. 2005) "Solution Structure and Dynamics of a Prototypical Chordin-like Cysteine-rich Repeat (von Willebrand Factor Type C Module) from Collagen IIA", Journal of Biological Chemistry, vol. 279, No. 51, pp. 53857-53866.
Ormo, et al. (1996) "Crystal Structure of the Aequo Rea Victoria Green Fluorescent Protein", Science, vol. 273, No. 5280, pp. 1392-1395.
Osterud, et al. (Jul. 18, 1972) "Activation of the Coagulation Factor VII by Tissue Thromboplastin and Calcium", Biochemistry, vol. 11, No. 15, pp. 2853-2857.
Padiolleau-Lefevre, et al. (Mar. 2007) "Expression and Detection Strategies for an scFv Fragment Retaining the Same High Affinity than Fab and Whole Antibody: Implications for Therapeutic Use in Prion Diseases", Molecular Immunology, vol. 44, Issue 8, pp. 1888-1896.
Pallaghy, et al. (Oct. 1994) "A Common Structural Motif Incorporating a Cystine Knot and a Triple-Stranded β-sheet in Toxic and Inhibitory Polypeptides", Protein Science, vol. 3, Issue 10, pp. 1833-1839.
Palmiter, et al. (1983) "Metallothionein-Human GH Fusion Genes Stimulate Growth of Mice", Science, vol. 222, No. 4625, pp. 809-814.
Pan, et al. (Dec. 1993) "Structure and Expression of Fibulin-2, A Novel Extracellular Matrix Protein with Multiple EGF-Like Repeats and Consensus Motifs for Calcium Binding", Journal of Cell Biology, vol. 123, Issue 5, pp. 1269-1277.
Pan, et al. (Sep. 24, 2009) "Enhanced efficacy of recombinant FVIII in noncovalent complex with PEGylated liposome in hemophilia A mice", Blood Journal, vol. 114, No. 13, pp. 2802-2811.
Panda, et al. (2003) "Bioprocessing of Therapeutic Proteins From the Inclusion Bodies of *Escherichia coli*", Advances in Biochemical Engineering / Biotechnology, vol. 85, pp. 43-93.
Panicali, et al. (Aug. 1982) "Construction of Poxviruses As Cloning Vectors: Insertion of the Thymidine Kinase Gene From Herpes Simplex Virus Into the DNA of Infectious Vaccinia Virus", Proceedings of the National Academy of Sciences of the United States of America, vol. 79, No. 16, pp. 4927-4931.
Park, et al. (2010) "A Diagnostic Challenge: Mild Hemophilia B With Normal Activated Partial Thromboplastin Time", Blood Coagulation & Fibrinolysis, vol. 21, No. 4, pp. 368-371.
Patra, et al. (Mar. 2000) "Optimization of Inclusion Body Solubilization and Renaturation of Recombinant Human Growth Hormone from *Escherichia coli*", Protein Expression and Purification, vol. 18, Issue 2, pp. 182-192.
Pelegrini, et al. (Nov. 2005) "Plant Gamma-Thionins: Novel Insights on the Mechanism of Action of a Multi-Functional Class of Defense Proteins", The International Journal of Biochemistry & Cell Biology, vol. 37, No. 11, pp. 2239-2253.
Pepinsky, et al. (Jun. 2001) "Improved Pharmacokinetic Properties of a Polyethylene Glycol-Modified Form of Interferon-β-1a with Preserved in Vitro Bioactivity", Journal of Pharmacology and Experimental Therapeutics, vol. 297, vol. 3, pp. 1059-1066.
Peters, et al. (Jan. 2013) "Biochemical and Functional Characterization of a Recombinant Monomeric Factor VIII-Fc Fusion Protein", Journal of Thrombosis and Haemostasis, vol. 11, No. 1, pp. 132-141.
Peters, et al. (Mar. 1, 2010) "Prolonged Activity of Factor IX As a Monomeric Fc Fusion Protein", Blood, vol. 115, No. 10, pp. 2057-2064.
Petersen, et al. (Nov. 25, 2003) "The Dual Nature of Human Extracellular Superoxide Dismutase: One Sequence and Two Structures", Proceedings of the National Academy of Sciences of the United States of America, vol. 100, No. 24, pp. 13875-13880.
Pi, et al. (Feb. 2006) "Analysis of Expressed Sequence Tags from the Venom Ducts of Conus striatus: Focusing on the Expression Profile of Conotoxins", Biochimie, vol. 88, Issue 2, pp. 131-140.

(56) References Cited

OTHER PUBLICATIONS

Pimanda, et al. (Nov. 2002) "The von Willebrand Factor-Reducing Activity of Thrombospondin-1 is Located in the Calcium-Binding/C-Terminal Sequence and Requires a Free Thiol At Position 974", Blood, vol. 100, No. 8, pp. 2832-2838.
Pipe, et al. (2011) "Functional Factor VIII Made With Von Willebrand Factor At High Levels in Transgenic Milk", Journal of Thrombosis and Haemostasis, vol. 9, No. 11, pp. 2235-2242.
Pipe, et al. (Nov. 2009) "Functional Roles of the Factor VIII B Domain", Haemophilia, vol. 15, No. 6, pp. 1187-1196.
Pipe, Stewen W. (2005) "The Promise and Challenges of Bioengineered Recombinant Clotting Factors", Journal of Thrombosis and Haemostasis, vol. 3, No. 8, pp. 1692-1701.
Pokidysheva, et al. (2004) "The Structure of the Cys-Rich Terminal Domain of Hydra Minicollagen, Which Is Involved in Disulfide Networks of the Nematocyst Wall", The Journal of Biological Chemistry, vol. 279, No. 29, pp. 30395-30401.
Popkov, et al. (2004) "Isolation of Human Prostate Cancer Cell Reactive Antibodies Using Phage Display Technology", Journal of Immunological Methods, vol. 291, No. 1-2, pp. 137-151.
Powell, et al. (Mar. 29, 2012) "Safety and Prolonged Activity of Recombinant Factor VIII Fc fusion protein in Hemophilia A Patients", Blood, vol. 119, No. 13, pp. 3031-3037.
Prilusky, et al. (2005) "FoldIndex: A Simple Tool to Predict Whether a Given Protein Sequence is Intrinsically Unfolded", Bioinformatics, vol. 21, No. 16, pp. 3435-3438.
Prinz, et al. (1997) "The Role of the Thioredoxin and Glutaredoxin Pathways in Reducing Protein Disulfide Bonds in the *Escherichia coli* Cytoplasm", The Journal of Biological Chemistry, vol. 272, No. 25, pp. 15661-15667.
Qi, et al. (2005) "Structural Features and Molecular Evolution of Bowman-Birk Protease Inhibitors and their Potential Application", Acta Biochimica Et Biophysica Sinica, vol. 37, No. 5, pp. 283-292.
Rao, et al. (1985) "Activation of Human Factor VII During Clotting In Vitro", Blood, vol. 65, No. 1, pp. 218-226.
Rao, et al. (1998) "Molecular and Biotechnological aspects of Microbial Proteases", Microbiology and Molecular Biology Reviews: MMBR, vol. 62, No. 3, pp. 597-635.
Rasmussen, et al. (2002) "Tumor Cell-Targeting by Phage-Displayed Peptides", Cancer Gene Therapy, vol. 9, No. 7, pp. 606-612.
Rawlings, et al. (2004) "Evolutionary Families of Peptidase Inhibitors", The Biochemical Journal, vol. 378, Part 3, pp. 705-716.
Rawlings, et al. (2008) "Merops: The Peptidase Database", Nucleic Acids Research vol. 36, Supplement 1, pp. D320-D325.
Roberge, et al. (2006) "Construction and Optimization of a Cc49-Based Scfv-Beta-Lactamase Fusion", Protein Engineering, Design & Selection: PEDS, vol. 19, No. 4, pp. 141-145.
Rodriguez-Merchan, Carlos E. (2003) "Management of Musculoskeletal Complications of Hemophilia", Seminars in Thrombosis and Hemostasis., vol. 29, No. 01, pp. 87-96.
Roovers, et al. (Mar. 2007) "Efficient Inhibition of EGFR Signaling and of Tumour Growth by Antagonistic anti-EFGR Nanobodies", Cancer Immunology, Immunotherapy, vol. 56, No. 3, pp. 303-317.
Rosa, et al. (2000) "Influence of the Co-Encapsulation of Different Non-Ionic Surfactants on the Properties of PLGA insulin-Loaded Micro spheres", Journal of Controlled Release, vol. 69, No. 2, pp. 283-295.
Rosenfeld, et al. (1998) "Biochemical, Biophysical, and Pharmacological Characterization of Bacterially Expressed Human Agouti-Related Protein", Biochemistry, vol. 37, No. 46, pp. 16041-16052.
Roth, et al. (1993) "Expression of Polysialic Acid in Human Tumors and Its Significance for Tumor Growth", Polysialic Acid: From Microbes to Man, Edited by Roth et al., pp. 335-348.
Roussel, et al. (2001) "Complexation of Two Proteic insect inhibitors to the Active Site of Chymotrypsin Suggests Decoupled Roles for Binding and Selectivity", The Journal of Biological Chemistry, vol. 276, No. 42, pp. 38893-38898.
Routledge, et al. (Oct. 1, 1995) "The Effect of Aglycosylation on the Immunogenicity of a Humanized Therapeutic CD3 Monoclonal Antibody", Transplantation, vol. 60, No. 8, pp. 847-853.
Ruberti, et al. (Jul. 12, 1994) "The Use of the RACE Method to Clone Hybridoma cDNA When V Region Primers Fail", Journal of Immunological Methods, vol. 173, No. 1, pp. 33-39.
Ruther, et al. (Oct. 1983) "Easy Identification of cDNA Clones", The EMBO Journal, vol. 2, No. 10, pp. 1791-1794.
Rychkov, et al. (2007) "Joint Neighbors Approximation of Macromolecular Solvent Accessible Surface Area", Journal of Computational Chemistry, vol. 28, No. 12, pp. 1974-1989.
Saenko, et al. (Apr. 15, 1994) "A Role for the C2 Domain of Factor VIII in Binding to von Willebrand Factor", Journal of Biological Chemistry, vol. 269, No. 15, pp. 11601-11605.
Saenko, et al. (1999) "Role of the Low Density Lipoprotein-Related Protein Receptor in Mediation of Factor VIII Catabolism", The Journal of Biological Chemistry, vol. 274, No. 53, pp. 37685-37692.
Saenko, et al. (Jul. 2006) "Strategies Towards a Longer Acting Factor VIII", Haemophilia, vol. 12, Supplement 3, pp. 42-51.
Saenko, et al. (1997) "The Acidic Region of the Factor VIII Light Chain and the C2 Domain Together Form the High Affinity Binding Site for Von Willebrand Factor", Journal of Biological Chemistry, vol. 272, No. 29, pp. 18007-18014.
Saenko, et al. (2005) "The Future of Recombinant Coagulation Factors", Journal of Thrombosis and Haemostasis, vol. 1, pp. 922-930.
Sahdev, et al. (Jan. 2008) "Production of Active Eukaryotic Proteins Through Bacterial Expression Systems: A Review of the Existing Biotechnology Strategies", Molecular and Cellular Biochemistry, vol. 307, No. 1-2, pp. 249-264.
Salloum, et al. (Apr. 2009) "Anakinra in Experimental Acute Myocardial Infarction-Does Dosage or Duration of Treatment Matter?", Cardiovascular Drugs and Therapy Sponsored by the International Society of Cardiovascular Pharmacotherapy, vol. 23, No. 2, pp. 129-135.
Sarver, et al. (Dec. 1987) "Stable Expression of Recombinant Factor Viii Molecules Using a Bovine Papillomavirus Vector", DNA, vol. 6, No. 6, pp. 553-564.
Scandella, et al. (Aug. 1, 1988) "Epitope Mapping of Human Factor VIII Inhibitor Antibodies by Deletion Analysis of Factor VIII Fragments Expressed in *Escherichia coli*", Proceedings of the National Academy of Sciences, vol. 85, No. 16, pp. 6152-6156.
Scandella, et al. (1989) "Localization of Epitopes for Human Factor VIII Inhibitor Antibodies by Immunoblotting and Antibody Neutralization", Blood, vol. 74, No. 5, pp. 1618-1626.
Schellenberger, et al. (Dec. 2009) "A Recombinant Polypeptide Extends the In Vivo Half-Life of Peptides and Proteins in a Tunable Manner", Nature Biotechnology, vol. 27, No. 12, pp. 1186-1192.
Schellenberger, et al. (1993) "Analysis of Enzyme Specificity by Multiple Substrate Kinetics", Biochemistry, vol. 32, No. 16, pp. 4344-4348.
Schlapschy, et al. (Jun. 1, 2007) "Fusion of a Recombinant Antibody Fragment With a Homo-Amino-Acid Polymer: Effects on Biophysical Properties and Prolonged Plasma Half-Life", Protein Engineering, Design and Selection, vol. 20, No. 6, pp. 273-284.
Schmidt, et al. (2003) "Structure-Function Relationships in Factor IX and Factor IXa", Trends in Cardiovascular Medicine, vol. 13, No. 1, pp. 39-45.
Schulte, et al. (2007) "Prolonged In-Vivo Half-Life of FVIIa by Fusion to Albumin", Blood, vol. 110, No. 11, Abstract 3142, American Society of Hematology, United States.
Schulte, S (2011) "Pioneering Designs for Recombinant Coagulation Factors", Thrombosis Research, vol. 128, Supplement 1, pp. S9-S12.
Schulte, Stefan (Dec. 2008) "Use of Albumin Fusion Technology to Prolong the Half-Life of Recombinant Factor", Thrombosis Research, vol. 122, Supplement 4, pp. S14-S19.
Schultz-Cherry, et al. (1995) "Regulation of Transforming Growth Factor-Beta Activation by Discrete Sequences of Thrombospondin 1", Journal of Biological Chemistry, vol. 270, No. 13, pp. 7304-7310.

(56) References Cited

OTHER PUBLICATIONS

Schultz-Cherry, et al. (1994) "The Type 1 Repeats of Thrombospondin 1 Activate Latent Transforming Growth Factor-Beta", The Journal of Biological Chemistry, vol. 269, No. 43, pp. 26783-26788.

Schulz, et al. (2005) "Potential of Nir-Ft-Raman Spectroscopy in Natural Carotenoid Analysis", Biopolymers, vol. 77, No. 4, pp. 212-221.

Shapiro, et al. (Jan. 19, 2012) "Recombinant Factor IX-Fc Fusion Protein (rFIXFc) Demonstrates Safety and Prolonged Activity in a Phase 1/2a Study in Hemophilia B Patients", Blood, vol. 119, No. 3, pp. 666-672.

Sheffield, et al. (2004) "Effects of Genetic Fusion of Factor IX to Albumin on In Vivo Clearance in Mice and Rabbits", British Journal of Haematology, vol. 126, No. 4, pp. 565-573.

Shen, et al. (1998) "A Type I Peritrophic Matrix Protein from the Malaria Vector Anopheles Gambiae Binds to Chitin Cloning, Expression, and Characterization", Journal of Biological Chemistry, vol. 273, No. 28, pp. 17665-17670.

Shen, et al. (Feb. 1, 2008) "The Tertiary Structure and Domain Organization of Coagulation Factor VIII", Blood, vol. 111, No. 3, pp. 1240-1247.

Shields, et al. (Mar. 2, 2001) "High Resolution Mapping of the Binding Site on Human IgG1 for Fc Gamma RI, Fc Gamma RII, Fc Gamma RIII, and FcRn and Design of IgG1 Variants With Improved Binding to the Fc Gamma R", Journal of Biological Chemistry, vol. 276, No. 9, pp. 6591-6604.

Shima, et al. (1993) "A Factor VIII Neutralizing Monoclonal Antibody and a Human Inhibitor Alloantibody Recognizing Epitopes in the C2 Domain Inhibit Factor VIII Binding to Von Willebrand Factor and to Phosphatidy Lserine", Journal of Thrombosis and Haemostasis, vol. 69, No. 3, pp. 240-246.

Sidhu, et al. (2000) "Phage Display for Selection of Novel Binding Peptides", Methods in Enzymology, vol. 328, Number, pp. 333-363.

Silverman, et al. (2005) "Multivalent Avimer Proteins Evolved by Exon Shuffling of a Family of Human Receptor Domains", Nature Biotechnology, vol. 23, No. 12, pp. 1556-1561.

Simioni, et al. (Oct. 22, 2009) "X-Linked Thrombophilia With a Mutant Factor IX (Factor IX Padua)", The New England Journal of Medicine, vol. 361, No. 17, pp. 1671-1675.

Simonet, et al. (2002) "Structural and Functional Properties of a Novel Serine Protease Inhibiting Peptide Family in Arthropods", Comparative Biochemistry and Physiology. Part B, Biochemistry & Molecular Biology, vol. 132, No. 1, pp. 247-255.

Simonsen, et al. (May 1983) "Isolation and Expression of an Altered Mouse Dihydrofolate Reductase cDNA", Proceedings of the National Academy of Sciences of the United States of America, vol. 80, No. 9, pp. 2495-2499.

Singh, et al. (Dec. 2001) "Propred: Prediction of HLA-DR Binding Sites", Bioinformatics, vol. 17, No. 12, pp. 1236-1237.

Skinner, et al. (1989) "Purification and Characterization of Two Classes of Neurotoxins from the Funnel Web Spider, Agelenopsis Aperta", The Journal of Biological Chemistry, vol. 264, No. 4, pp. 2150-2155.

Smith, et al. (Dec. 1981) "Comparison of Biosequences", Advances in Applied Mathematics, vol. 2, No. 4, pp. 482-489.

Smith, et al. (May 1983) "Molecular Engineering of the Autographa californica Nuclear Polyhedrosis Virus Genome: Deletion Mutations Within the Polyhedrin Gene", Journal of Virology, vol. 46, No. 2, pp. 584-593.

Smith, et al. (1997) "Phage Display", Chemical Reviews, vol. 97, vol. 2, pp. 391-410.

Smith, et al. (1988) "Single-Step Purification of Polypeptides Expressed in *Escherichia coli* As Fusions With Glutathione S-Transferase", Gene, vol. 67, No. 1, pp. 31-40.

So, et al. (2001) "Contribution of Conformational Stability of Hen Lysozyme to Induction of Type 2 T-Helper Immune Responses", Immunology, vol. 104, No. 3, pp. 259-268.

Sommermeyer, et al. (1987) "Klinisch verwendete Hydroxyethylstärke: physikalischchemische Charakterisierung", Krankenhauspharmazie, vol. 8, No. 8, Deutscher Apotheker Verlag, Birkenwaldstr, Germany, pp. 271-278.

Southern, et al. (1982) "Transformation of Mammalian Cells to Antibiotic Resistance With a Bacterial Gene Under Control of the Sv40 Early Region Promoter", Journal of Molecular and Applied Genetics 1, No. 4, pp. 327-341.

Spencer, et al. (2011) "Lentiviral Vector Platform for Production of Bioengineered Recombinant Coagulation Factor VIII", Molecular Therapy, vol. 19, No. 2, pp. 302-309.

Stamos, et al. (2004) "Crystal Structure of the HGF Beta-Chain in Complex With the Sema Domain of the Met Receptor", The EMBO Journal, vol. 23, No. 12, pp. 2325-2335.

Steipe, et al. (Jul. 15, 1994) "Sequence Statistics Reliably Predict Stabilizing Mutations in a Protein Domain", Journal of Molecular Biology, vol. 240, No. 3, pp. 188-192.

Stemmer, et al. (1995) "Single-Step Assembly of a Gene and Entire Plasmid from Large Numbers of Oligodeoxyribonucleotides", Gene, vol. 164, No. 1, pp. 49-53.

Stites, et al. (1995) "Empirical Evaluation of the Influence of Side Chains on the Conformational Entropy of the Polypeptide Backbone", Proteins: Structure, Function, and Bioinformatics, vol. 22, No. 2, pp. 132-140.

Story, et al. (Dec. 1, 1994) "A Major Histocompatibility Complex Class I-like Fc Receptor Cloned From Human Placenta: Possible Role in Transfer of Immunoglobulin G From Mother to Fetus", Journal of Experimental Medicine, vol. 180, No. 6, pp. 2377-2381.

Sturniolo, et al. (1999) "Generation of Tissue-Specific and Promiscuous HLA Ligand Database Using DNA Microarrays and Virtual HLA Class II Matrices", National Biotechnology, vol. 17, No. 6, pp. 555-561.

Subramani, et al. (1981) "Expression of the Mouse Dihydrofolate Reductase Complementary Deoxyribonucleic Acid in Simian Virus 40 Vectors", Molecular and Cellular Biology, vol. 1, No. 9, pp. 854-864.

Suetake, et al. (2000) "Chitin-Binding Proteins in Invertebrates and Plants Comprise a Common Chitin-Binding Structural Motif", The Journal of Biological Chemistry, vol. 275, No. 24, pp. 17929-17932.

Supplementary European Search Report received for European Patent Application No. 12868427, dated Sep. 18, 2015, 8 Pages.

Takenobu, et al. (2002) "Development of P53 Protein Transduction Therapy Using Membrane-Permeable Peptides and the Application to Oral Cancer Cells", Molecular Cancer Therapeutics, vol. 1, No. 12, pp. 1043-1049.

Tam, et al. (1998) "A Biomimetic Strategy in the Synthesis and Fragmentation of Cyclic Protein", Protein Science, vol. 7, No. 7, pp. 1583-1592.

Tax, et al. (1994) "Sequence of C elegans Lag-2 Reveals a Cell-Signalling Domain Shared with Delta and Serrate of *Drosophila*", Nature, vol. 368, No. 6467, pp. 150-154.

Terpe, K. (2003) "Overview of Tag Protein Fusions: From Molecular and Biochemical Fundamentals to Commercial Systems", Applied Microbiology and Biotechnology, vol. 60, No. 5, pp. 523-533.

Thai, et al. (2004) "Antigen Stability Controls Antigen Presentation", The Journal of Biological Chemistry, vol. 279, No. 48, pp. 50257-50266.

Thomas, Patrica S. (1980) "Hybridization of Denatured RNA and Small DNA Fragments Transferred to Nitrocellulose", Proceedings of the National Academy of Sciences vol. 77, No. 9, pp. 5201-5205.

Thorner (2000) "Methods in Enzymology, Applications of Chimeric Genes and Hybrid Proteins", Academic Press, San Diego, CA, 28 Pages.

Toby, et al. (Feb. 3, 2016) "Recombinant Factor IX Fc Fusion Protein Maintains Full Procoagulant Properties and Exhibits Prolonged Efficacy in Hemophilia B Mice", PLoS ONE, vol. 11, No. 2, e0148255, pp. 1-20.

Tolkatchev, et al. (2000) "Design and Solution Structure of a Well-Folded Stack of Two Beta-Hairpins Based on the Amino-Terminal Fragment of Human Granulin A", Biochemistry, vol. 39, No. 11, pp. 2878-2886.

(56) References Cited

OTHER PUBLICATIONS

Toole, et al. (Aug. 1986) "A Large Region (Approximately Equal to 95 kDa) of Human Factor VIII Is Dispensable for In Vitro Procoagulant Activity", Proceedings of the National Academy of Sciences, vol. 83, No. 16, pp. 5939-5942.

Toole, et al. (Nov. 22-28, 1984) "Molecular Cloning of a cDNA Encoding Human Antihaemophilic Factor", Nature, vol. 312, No. 5992, pp. 342-347.

Torres, et al. (1999) "Solution Structure of a Defensin-Like Peptide from Platypus Venom", The Biochemical Journal, vol. 341, Part 3, pp. 785-794.

Towfighi, et al. (2005) "Comparative Measurement of Anti-Factor VIII Antibody by Bethesda Assay and ELISA Reveals Restricted Isotype Profile and Epitope Specificity", Acta Haematolll, vol. 4, No. 2, pp. 84-90.

Trussel, et al. (Dec. 2009) "New Strategy for the Extension of the Serum Half-Life of Antibody Fragments", Bioconjugate Chemistry, vol. 20, No. 12, pp. 2286-2292.

Tur, et al. (2003) "Novel Approach for Immunization, Screening and Characterization of Selected Scfv Libraries Using Membrane Fractions of Tumor Cells", International Journal of Molecular Medicine, vol. 11, No. 4, pp. 523-527.

UniProtKB (Dec. 16, 2014) "ELNE_HUMAN", UniProtKB, Accession No. P08246; Retrieved from: <<http://www.uniprot.org/uniprot/P08246>>, 19 Pages.

UniProtKB (Dec. 16, 2014) "FA10_HUMAN", Accession No. P00742, Retrieved from: <<https://www.uniprot.org/uniprot/P00742>>, 25 Pages.

UniProtKB (Dec. 16, 2014) "FA11_HUMAN", Accession No. P03951, Retrieved from: https://www.uniprot.org/uniprot/P03951, 22 Pages.

UniProtKB (Dec. 16, 2014) "FA12_HUMAN", Accession No. P00748; Retrieved from: <<https://www.uniprot.org/uniprot/P03951>>, 14 Pages.

UniProtKB (Dec. 16, 2014) "FA7_HUMAN", Accession No. P08709, Retrieved from:<<https://www.uniprot.org/uniprot/P08709>>, 27 Pages.

UniProtKB (Dec. 16, 2014) "FA9_HUMAN", Accession No. P00740, 26 Pages.

UniProtKB (Dec. 16, 2014) "KLKB1_HUMAN", Accession No. P03952; Retrieved from: <<https://www.uniprot.org/uniprot/P03952>>, 11 Pages.

UniProtKB (Dec. 16, 2014) "MMP12_HUMAN", UniProtKB, Accession No. P39900, Retrieved from: <<https://www.uniprot.org/uniprot/P39900>> , 12 pages.

UniProtKB (Dec. 16, 2014,) "MMP13_HUMAN", UniProtKB, Accession No. P45452; Retrieved from: <<https://www.uniprot.org/uniprot/P45452>>, 15 Pages.

UniProtKB (Dec. 16, 2014) "MMP17_HUMAN", UniProtKB, Accession No. Q9ULZ9, Retrieved from https://www.uniprot.org/uniprot/Q9ULZ9, 11 Pages.

UniProtKB (Dec. 16, 2014) "MMP20 Human", UniProtKB, Accession No. O60882, Retrieved from: <<https://www.uniprot.org/uniprot/O60882>>, 10 pages.

Urlaub, et al. (Jul. 1980) "Isolation of Chinese Hamster Cell Mutants Deficient in Dihydrofolate Reductase Activity", Proceedings of the National Academy of Sciences of the United States of America, vol. 77, No. 7, pp. 4216-4220.

Uttamapinant, et al. (Jun. 2010) "Fluorophore Ligase for Site-Specific Protein Labeling Inside Living Cells", Proceedings of the National Academy of Sciences, vol. 107, No. 24, pp. 10914-10919.

Uversky, et al. (2000) "Why Are "Natively Unfolded" Proteins Unstructured Under Physiologic Conditions?", Proteins: Structure, Function and Genetics, vol. 41, No. 3, pp. 415-427.

Valjakka, et al. (1998) "Unreliability of the Chou-Fasman Parameters in Predicting Protein Secondary Structure", Protein Engineering, vol. 11, No. 5, pp. 345-348.

Van Den Hooven, et al. (2001) "Disulfide Bond Structure of the AVR9 Elicitor of the Fungal Tomato Pathogen Cladosporium fulvum: Evidence for a Cystine Knot", Biochemistry, vol. 40, No. 12, pp. 3458-3466.

Van Vlijmen, et al. (2004) "A Novel Database of Disulfide Patterns and Its Application to the Discovery of Distantly Related Homologs", Journal of Molecular Biology, vol. 335, No. 4, pp. 1083-1092.

Vanhercke, et al. (2005) "Reducing Mutational Bias in Random Protein Libraries", Analytical Biochemistry, vol. 339, No. 1, pp. 9-14.

Vardar, et al. (2003) "Nuclear Magnetic Resonance Structure of a Prototype Lin12-Notch Repeat Module from Human Notch1", Analytical Biochemistry, vol. 339, No. 1, pp. 7061-7067.

Vehar, et al. (Nov. 1984) "Structure of Human Factor VIII", Nature, vol. 312, No. 5992, pp. 337-342.

Venkateswarlu, Divi (Feb. 25, 2010) "Structural Investigation of Zymogenic and Activated Forms of Human Blood Coagulation Factor VIII: A Computational Molecular Dynamics Study", BMC Structural Biology vol. 10, Article No. 7, 20 Pages.

Venkateswarlu, Divi (Sep. 26, 2014) "Structural Insights Into the Interaction of Blood Coagulation Co-Factor VIIIa with factor IXa: A Computational Protein-Protein Docking and Molecular Dynamics Refinement Study", Biochemical and Biophysical Research Communications, vol. 452, No. 3, pp. 408-414.

Verbruggen, et al. (Nov. 2009) "Improvements in Factor VIII Inhibitor Detection: From Bethesda to Nijmegen", Seminars in Thrombosis and Hemostasis, vol. 35, No. 8, pp. 752-759.

Verbruggen, et al. (1995) "The Nijmegen modification of the Bethesda assay for factor VIII:C inhibitors: improved specificity and reliability", Journal of Thrombosis and Haemostasis, vol. 73, No. 2, pp. 247-251.

Vorobjev, et al. (Nov.-Dec. 1999) "Oligonucleotide Conjugated to Linear and Branched High Molecular Weight Polyethylene Glycol As Substrates for RNase H", Nucleosides and Nucleotides, vol. 18, No. 11-12, pp. 2745-2750.

Wagenvoord, et al. (1989) "Development of a Simple Chromogenic Factor VIII Assay for Clinical Use", Haemostasis, vol. 19, No. 4, pp. 196-204.

Wang, et al. (1988) "Parenteral Formulations of Proteins and Peptides: Stability and Stabilizers", Journal of Parenteral Science and Technology, vol. 42, pp. S2-S24.

Wang, et al. (Nov. 7, 2011) "Receptor-Mediated Activation of a Proinsulin-Transferrin Fusion Protein in Hepatoma Cells", Journal of Controlled Release, vol. 155, No. 3, pp. 386-392.

Ward, et al. (Oct. 12, 1989) "Binding Activities of a Repertoire of Single Immunoglobulin Variable Domains Secreted From *Escherichia coli*", Nature, vol. 341, No. 6242, pp. 544-546.

Ward, et al. (Apr. 1995) "The Effector Functions of Immunoglobulins: Implications for Therapy", Therapeutic immunology, vol. 2, No. 2, pp. 77-94.

Wasley, et al. (Apr. 25, 1993) "PACE/furin can Process the Vitamin K-Dependent Pro-Factor IX Precursor within the Secretory Pathway", The Journal of Biological Chemistry, vol. 268, No. 12, pp. 8458-8465.

Watters, et al. (1997) "An Optimized Method for Cell-Based Phage Display Panning", Immunotechnology, vol. 3, No. 1, pp. 21-29.

Weidler, et al. (May 1991) "Pharmacokinetic Parameters As Criteria for Clinical Use of Hydroxyethyl Starch Preparations", Arzneimittelforschung/Drug Research, vol. 41, No. 5, pp. 494-498.

Weimer, et al. (Apr. 2008) "Prolonged In-Vivo Half-Life of Factor VIIa by Fusion to Albumin", Thrombosis and Haemostasis, vol. 99, No. 04, pp. 659-667.

Weiss, et al. (1995) "A Cooperative Model for Receptor Recognition and Cell Adhesion: Evidence from the Molecular Packing in the 1.6-A Crystal Structure of the Pheromone Er-1 from the Ciliated Protozoan Euplotes Raikovi", Proceedings of the National Academy of Sciences of the United States of America, vol. 92, No. 22, pp. 10172-10176.

Weiss, et al. (1977) "Stabilization of Factor VIII in Plasma by the Von Willebrand Factor: Studies on Posttransfusion and Dissociated Factor Viii and in Patients With Von Willebrand's Disease", The Journal of Clinical Investigation, vol. 60, No. 2, pp. 390-404.

Wentzel, et al. (1999) "Sequence Requirements of the GPNG Beta-Turn of the Ecballium elaterium Trypsin Inhibitor II Explored by Combinatorial Library Screening", The Journal of Biological Chemistry, vol. 274, No. 30, pp. 21037-21043.

(56) References Cited

OTHER PUBLICATIONS

Werle, et al. (2006) "The Potential of Cystine-Knot Microproteins As Novel Pharmacophoric Scaffolds in Oral Peptide Drug Delivery", Journal of Drug Targeting, vol. 14, No. 3, pp. 137-146.
Werther, et al. (1996) "Humanization of an Anti-Lymphocyte Function-associated Antigen (LFA)-1 Monoclonal Antibody and Reengineering of the Humanized Antibody for Binding to Rhesus LFA-1", Journal of Immunology, vol. 157, No. 1, pp. 4986-4995.
White, et al. (1989) "Factor VIII Gene and Hemophilia A", Blood, vol. 73, No. 1, pp. 1-12.
Whitlow, et al. (1994) "Multivalent Fvs: Characterization of Single-Chain Fv Oligomers and Preparation of a Bispecific Fv", Protein Engineering, vol. 7, No. 8, pp. 1017-1026.
Wigler, et al. (Jul. 1978) "Biochemical Transfer of Single-Copy Eucaryotic Genes Using Total Cellular DNA As Donor", Cell, vol. 14, No. 3, pp. 725-731.
Winter, et al. (Jun. 1, 1993) "Humanized Antibodies", Immunology Today, vol. 14, No. 6, pp. 243-246.
Wittrup, K. D. (2001) "Protein Engineering by Cell-Surface Display", Current Opinion in Biotechnology, vol. 12, No. 4, pp. 395-399.
Wood, et al. (Nov. 22-28, 1984) "Expression of Active Human Factor VIII From Recombinant DNA Clones", Nature, vol. 312, No. 5992, pp. 330-337.
Worn, et al. (2000) "Correlation Between In Vitro Stability and In Vivo Performance of Anti-Gcn4 Intrabodies As Cytoplasmic Inhibitors", The Journal of Biological Chemistry, vol. 275, No. 4, pp. 2795-2803.
Worn, et al. (2001) "Stability Engineering of Antibody Single-Chain Fv Fragments", Journal of Molecular Biology, vol. 305, No. 5, pp. 989-1010.
Wrammert, et al. (May 2008) "Rapid Cloning of High-Affinity Human Monoclonal Antibodies Against Influenza Virus", Nature, vol. 453, No. 7195, pp. 667-671.
Wright, et al. (1999) "Intrinsically Unstructured Proteins: Re-Assessing the Protein Structure-Function Paradigm", Journal of Molecular Biology, vol. 293, No. 2, pp. 321-331.
Xiong, et al. (2004) "A Novel Adaptation of the Integrin Psi Domain Revealed from Its Crystal Structure", The Journal of Biological Chemistry, vol. 279, No. 39, pp. 40252-40254.
Xu, et al. (2000) "Solution Structure of Bmp02, A New Potassium Channel Blocker from the Venom of the Chinese ScorpionButhus Martensi Karsch", Biochemistry, vol. 39, No. 45, pp. 13669-13675.
Yamazaki, et al. (2003) "A Possible Physiological Function and the Tertiary Structure of a 4-Kda Peptide in Legumes", European Journal of Biochemistry / FEBS, vol. 270, No. 6, pp. 1269-1276.
Yang, et al. (1995) "CDR Walking Mutagenesis for the Affinity Maturation of a Potent Human Anti-Hiv-1 Antibody into the Picomolar Range", Journal of Molecular Biology, vol. 254, No. 3, pp. 392-403.
Yang, et al. (1999) "Intestinal Peptide Transport Systems and Oral Drug Availability", Pharmaceutical Research, vol. 16, No. 9, pp. 1331-1343.
Yang, et al. (2005) "RONN: The Bio-Basis Function Neural Network Technique Applied to the Detection of Natively Disordered Regions in Proteins", Bioinformatics, vol. 21, No. 16, pp. 3369-3376.
Yang, et al. (2003) "Tailoring Structure-Function and Pharmacokinetic Properties of Single-Chain Fv Proteins by Site-Specific PEGylation", Protein Engineering, vol. 16, No. 10, pp. 761-770.
Yankai, et al. (2006) "Ten Tandem Repeats of β-hCG 109-118 Enhance Immunogenicity and Anti-Tumor Effects of β-hCG C-Terminal Peptide Carried by Mycobacterial Heat-Shock Protein HSP65", Biochemical and Biophysical Research Communications, vol. 345, No. 4, pp. 1365-1371.
Yoshitake, et al. (Jul. 2, 1985) "Complete Nucleotide Sequence of the Gene for Human Factor IX (Antihemophilic Factor B)", Biochemistry, vol. 24, No. 14, pp. 3736-3750.
Yuan, et al. (1997) "Solution Structure of the Transforming Growth Factor Beta-Binding Protein-Like Module, A Domain Associated With Matrix Fibrils", The EMBO, Journal 16, No. 22, pp. 6659-6666.
Zaveckas, et al. (Jun. 1, 2007) "Effect of Surface Histidine Mutations and Their Number on the Partitioning and Refolding of Recombinant Human Granulocyte-Colony Stimulating Factor (Cys17ser) in Aqueous Two-Phase Systems Containing Chelated Metal Ions", Journal of Chromatography B, vol. 852, Issues 1-2, pp. 409-419.
Zhang, et al. (Oct. 2009) "Factor VIII Inhibitors: Risk Factors and Methods for Prevention and Immune Modulation", Clinical Reviews in Allergy & Immunology, vol. 37, Issue 2, pp. 114-124.
Zhou, et al. (Jun. 2005) "Procoagulant Stimulus Processing by the Intrinsic Pathway of Blood Plasma Coagulation", Biomaterials, vol. 26, Issue 16, pp. 2965-2973.
Zhou, et al. (Jul. 12, 2012) "Sequence and Structure Relationships Within Von Willebrand Factor", Blood, vol. 120, No. 2, pp. 449-458.
Zhu, et al. (Sep. 1999) "Molecular Cloning and Sequencing of Two 'Short Chain' and Two 'Long Chain' K (+) Channel-Blocking Peptides from the Chinese Scorpion Buthus Martensii Karsch", FEBS Letters, vol. 457, No. 3, pp. 509-514.

* cited by examiner

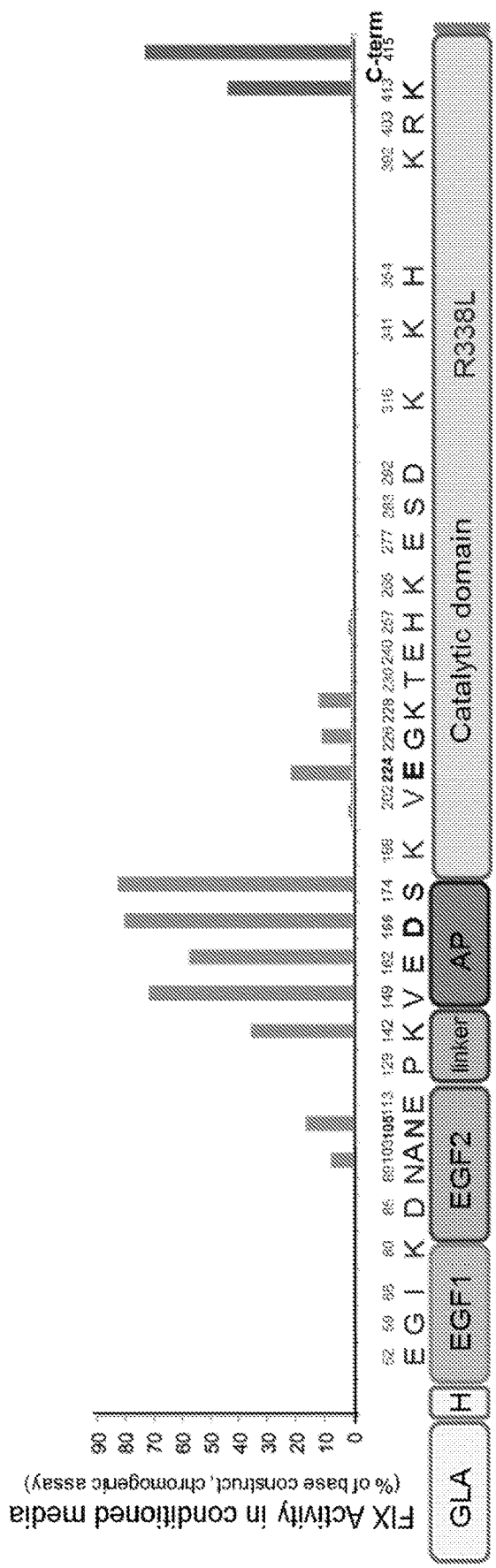
Figure 1 - Activity Screen of AE42 Insertions and C-Terminal Fusion

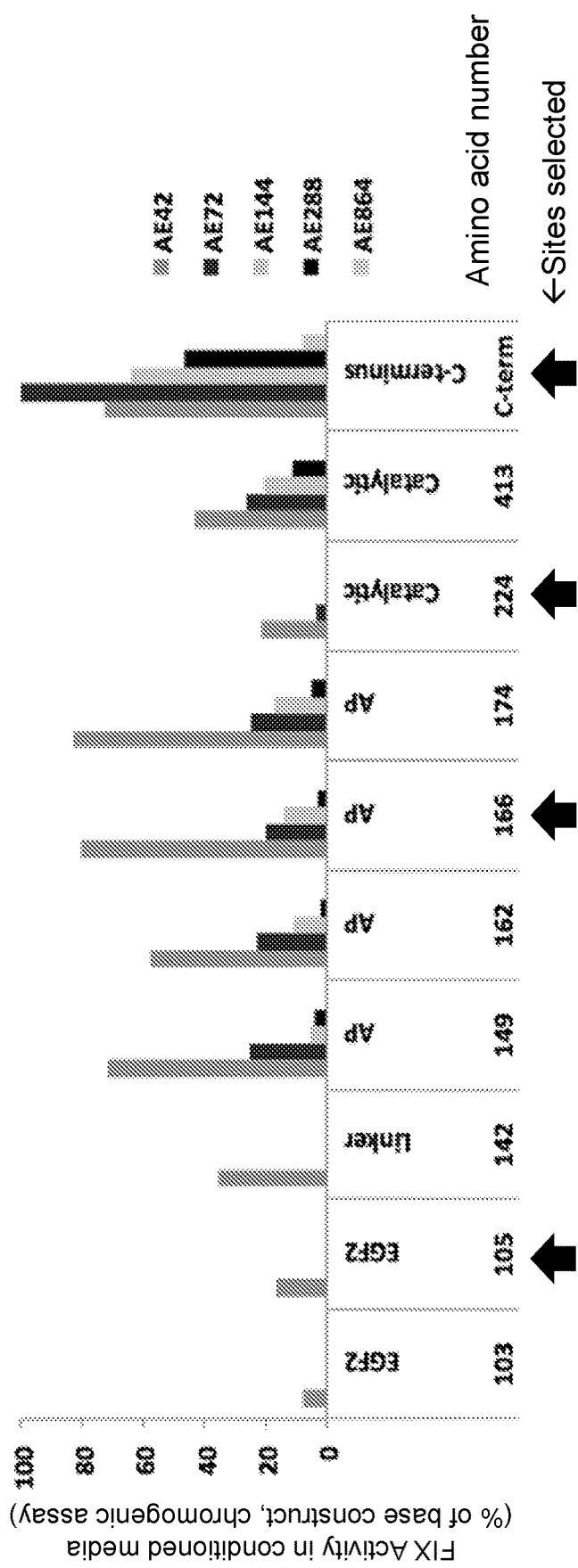
Figure 2 – Activity Screen of XTEN Insertion Sites and Lengths

Figure 3 – Four Selected Sites for a Combination Library in FIX

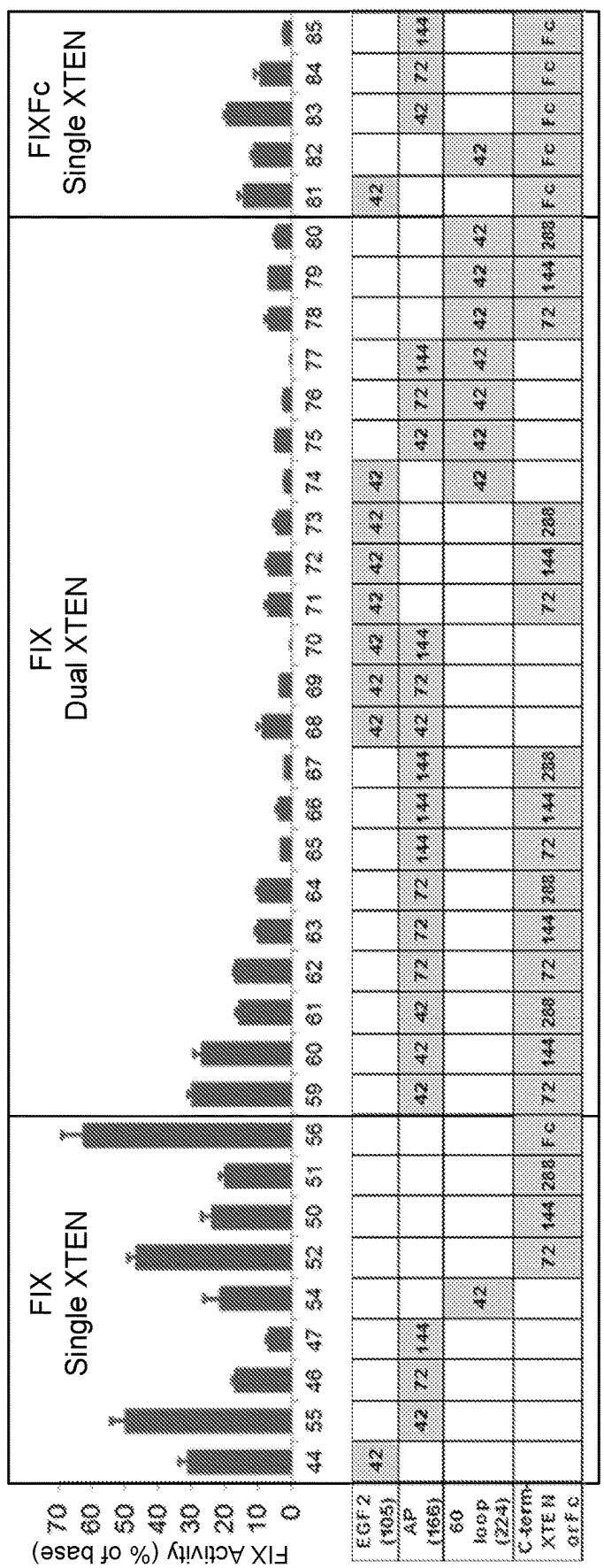
Figure 4 – Three Groups of FIX-XTEN Having Detectable Activity

Figure 6
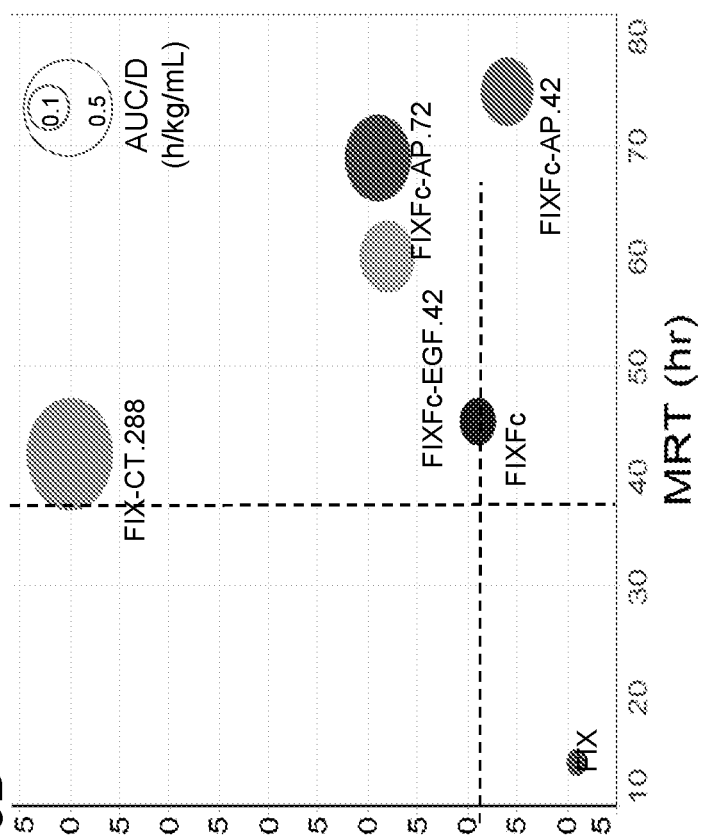
FIG. 6B
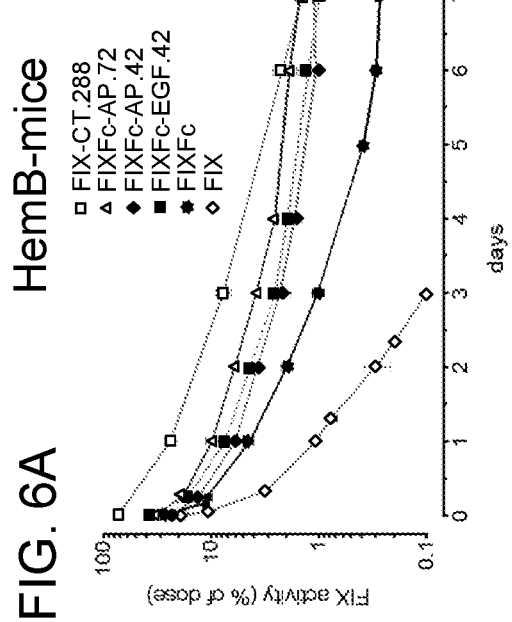
FIG. 6A

Figure 7
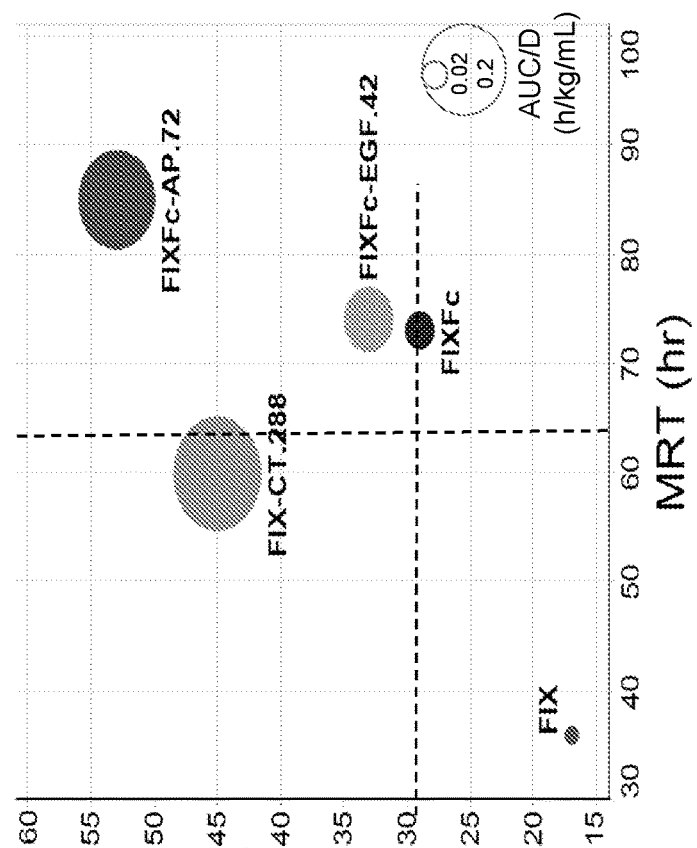
FIG. 7B
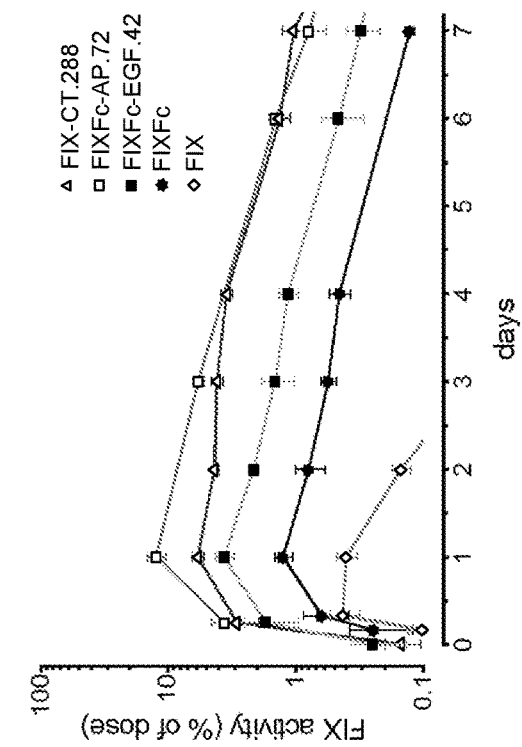
FIG. 7A

Figure 8
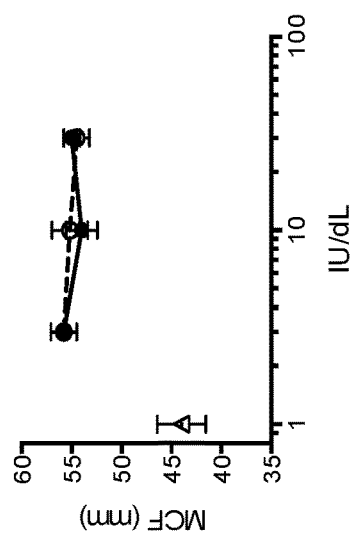
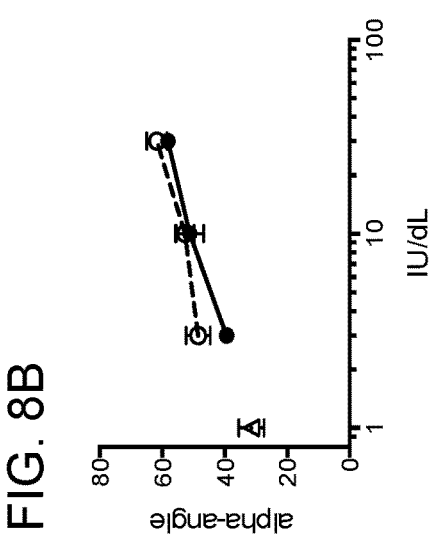
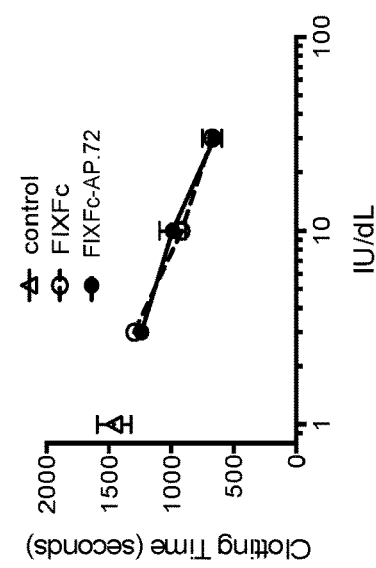

rFIXFc-AP.72 (dual Fc chain)

rFIXFc-AP.72 (Single Fc chain)

FIG. 13

| FIX construct name | SEQ ID NO | description | plasmid name |
|---|---|---|---|
| rFIX-CT.72 | 123 | R338L, C-term AE72 | pJH52 |
| rFIX-CT.144 | 121 | R338L, C-term AE144 | pJH50 |
| rFIX-CT-288 | 226 | R338L, C-term AE288-tag | FIX-102 |
| rFIX-CT.288 | 122 | R338L, C-term AE288 | pJH51 |
| rFIX-CT.864 | 116 | R338L, C-term AE864 | FIX-92 |
| rFIX-AP.72 | 119 | R338L, D166-AE72 | pJH46 |
| rFIX-AP.144 | 120 | R338L, D166-AE144 | pJH47 |
| rFIXFc-EGF.42 | 148 | R338L, N105-AE42, C-term-Fc | pJH81 |
| rFIXFc-AP.42 | 150 | R338L, D166-AE42, C-term Fc | pJH83 |
| rFIXFc-AP.72 | 151 | R338L, D166-AE72, C-term Fc | pJH84 |
| rFIXFc-AP.72 (dual chain Fc) | 227 & 228 | R338L, D166-AE72, C-term Fc (dual chain Fc) | FIX-216 |

FACTOR IX FUSION PROTEINS AND METHODS OF MAKING AND USING SAME

REFERENCE TO SEQUENCE LISTING SUBMITTED ELECTRONICALLY

The instant application contains a Substitute Sequence Listing which has been submitted in ASCII format via EFS-Web, and is hereby incorporated by reference in its entirety. Said ASCII copy, created on Aug. 1, 2018, is named 4159_466003_ST25.txt, and is 693,730 bytes in size. The content of the sequence listing that was originally submitted in the International Application No. PCT/US2016/045401 is incorporated herein by reference in its entirety.

BACKGROUND

Hemophilia B (also known as Christmas disease) is one of the most common inherited bleeding disorders in the world. It results in decreased in vivo and in vitro blood clotting activity and requires extensive medical monitoring throughout the life of the affected individual. In the absence of intervention, the afflicted individual will suffer from spontaneous bleeding in the joints, which produces severe pain and debilitating immobility; bleeding into muscles results in the accumulation of blood in those tissues; spontaneous bleeding in the throat and neck can cause asphyxiation if not immediately treated; renal bleeding; and severe bleeding following surgery, minor accidental injuries, or dental extractions also are prevalent.

Normal in vivo blood coagulation at minimum requires the serine proteases Factors II (prothrombin), VII, IX, X and XI (soluble plasma proteins); cofactors including the transmembrane protein tissue factor and the plasma proteins Factors V and VIII; fibrinogen, the transglutaminase Factor XIII, phospholipid (including activated platelets), and calcium. Additional proteins including kallikrein, high molecular weight kininogen, and Factor XII are required for some in vitro clotting tests, and can play a role in vivo under pathologic conditions.

In hemophilia, blood clotting is disturbed by a lack of certain plasma blood clotting factors. Hemophilia B is caused by a deficiency in Factor IX (FIX) that can result from either the decreased synthesis or absence of the FIX protein or a defective molecule with reduced activity. The treatment of hemophilia occurs by replacement of the missing clotting factor by exogenous factor concentrates highly enriched in FIX. However, generating such a concentrate from blood is fraught with technical difficulties, as is described below.

Purification of FIX from plasma (plasma derived FIX; pdFIX) almost exclusively yields fully-γ-carboxylated FIX. However, such purification of FIX from plasma is very difficult because FIX is only present in low concentration in plasma (5 µg/mL). Andersson, Thrombosis Research 7: 451 459 (1975). Further, purification from blood requires the removal or inactivation of infectious agents such as HIV and HCV. In addition, pdFIX has a short half-life and therefore requires frequent dosing. Recombinant Factor IX (rFIX) is also available, but suffers from the same short half-life and need for frequent dosing (e.g., 2-3 times per week for prophylaxis) as pdFIX.

Reduced mortality, prevention of joint damage and improved quality of life have been important achievements due to the development of plasma-derived and recombinant FIX. Prolonged protection from bleeding would represent another key advancement in the treatment of hemophilia B subjects. Therefore, there remains a need for improved recombinant FIX, which has a longer half-life, while maintaining an effective activity.

BRIEF SUMMARY OF THE INVENTION

Disclosed are specific Factor IX fusion proteins that include at least one XTEN. In one aspect, the invention provides a Factor IX (FIX) fusion protein comprising a FIX polypeptide and at least one XTEN which is inserted within the FIX polypeptide at an insertion site corresponding to an amino acid selected from the group consisting of amino acid 103 of SEQ ID NO: 2, amino acid 105 of SEQ ID NO: 2, amino acid 142 of SEQ ID NO: 2, amino acid 149 of SEQ ID NO: 2, amino acid 162 of SEQ ID NO: 2, amino acid 166 of SEQ ID NO: 2, amino acid 174 of SEQ ID NO: 2, amino acid 224 of SEQ ID NO: 2, amino acid 226 of SEQ ID NO: 2, amino acid 228 of SEQ ID NO: 2, amino acid 413 of SEQ ID NO: 2, and any combination thereof, and wherein the FIX fusion protein exhibits procoagulant activity.

The invention also provides for an FIX fusion protein comprising a FIX polypeptide and a heterologous moiety comprising an XTEN, wherein the XTEN 15 fused to the C-terminus of the FIX polypeptide and comprises an amino acid sequence of longer than 42 amino acids and shorter than 144 amino acids in length.

The FIX fusion proteins of the invention have several uses including providing a method of preventing, treating, ameliorating, or managing a clotting disease or condition in a patient in need thereof. In one embodiment, the method includes the step of administering an effective amount of the FIX fusion protein described herein (e.g., by subcutaneous administration).

The invention also provides for a method of extending a half-life of a FIX polypeptide comprising inserting an XTEN within the FIX polypeptide at an insertion site corresponding to an amino acid selected from the group consisting of amino acid 103 of SEQ ID NO: 2, amino acid 105 of SEQ ID NO: 2, amino acid 142 of SEQ ID NO: 2, amino acid 149 of SEQ ID NO: 2, amino acid 162 of SEQ ID NO: 2, amino acid 166 of SEQ ID NO: 2, amino acid 174 of SEQ ID NO: 2, amino acid 224 of SEQ ID NO: 2, amino acid 226 of SEQ ID NO: 2, amino acid 228 of SEQ ID NO: 2, amino acid 413 of SEQ ID NO: 2, and any combination thereof, thereby constructing a FIX fusion protein, wherein the FIX protein exhibits procoagulant activity.

Additional invention embodiments will be apparent from the description and figures that follow.

INCORPORATION BY REFERENCE

All publications, patents, and patent applications disclosed herein are incorporated by reference to the same extent as if each individual publication, patent or patent application was specifically and individually indicated to be incorporated by reference.

BRIEF DESCRIPTION OF THE DRAWINGS

FIG. 1 is a graph depicting the activity of FIX fusion proteins comprising an XTEN of 42 amino acids (e.g., AE42) inserted at various insertions sites (e.g., at amino acid 52, amino acid 59, amino acid 66, amino acid 80, amino acid 85, amino acid 89, amino acid 103, amino acid 105, amino acid 113, amino acid 129, amino acid 142, amino acid 149, amino acid 162, amino acid 166, amino acid 174, amino acid 188, amino acid 202, amino acid 224, amino acid 226, amino acid 228, amino acid 230, amino acid 240, amino acid 257, amino acid 265, amino acid 277, amino acid 283, amino acid 292, amino acid 316, amino acid 341, amino acid 354, amino acid 392, amino acid 403, and amino acid 413, corresponding to amino acids of SEQ ID NO: 2) or fused to the C-terminus (C-term) of the FIX polypeptide. C-terminus fused XTEN sequences contain an thrombin-cleavable site between FIX and the C-terminal fusion. The Y-axis shows the FIX activity as a percent of the activity of the base construct (FIX-R338L) in conditioned media by chromogenic assay. The X-axis shows the specific insertion sites as the amino acid number (corresponding to SEQ ID NO: 2) and the single-letter amino acid abbreviation. The corresponding domains (e.g., GLA, EGF1, EGF2, linker, AP, and the catalytic domain), linker regions, and C-terminus ("C-term") of FIX are indicated below the X-axis.

FIG. 2 is a graph depicting the activity of FIX fusion proteins comprising an XTEN of 42 amino acids (AE42), 72 amino acids (AE72), 144 amino acids (AE144), 288 amino acids (AE288), and 864 amino acids (AE864) inserted at various insertions sites (e.g., at amino acid 103, amino acid 105, amino acid 142, amino acid 149, amino acid 162, amino acid 166, amino acid 174, amino acid 224, and amino acid 413, corresponding to amino acids of SEQ ID NO:2) or fused to the C-terminus (C-term, amino acid 415) of the FIX polypeptide. The Y-axis shows the FIX activity as a percent of the activity of the base construct (FIX-R338L) in conditioned media by chromogenic assay. The X-axis shows the domain (e.g., EGF2, AP, and catalytic domains) or region (e.g., linker and C-terminus) of each insertion site and the specific insertion sites as the amino acid number (corresponding to SEQ ID NO: 2). Arrows indicate the insertion sites selected for further experimentation (see FIGS. 3A-3B).

FIG. 4 summarizes the relative activities of FIX fusion proteins comprising one or two XTENs (e.g., XTEN of 42, 72, 144, and 288 amino acids), or comprising one XTEN and one Fc domain, or FIXFc. The Y-axis shows the FIX activity as a percent of the activity of the base construct (FIX-R338L) in conditioned media by chromogenic assay. The X-axis shows the construct number, and the table below the X-axis shows the composition of XTEN and Fc for each construct tested. EGF2 (105), AP (166), 60 loop (224), and C-term XTEN or Fc indicate the position where the XTEN or Fc is inserted or fused. The numbers (e.g., 42, 72, 144, and 288, indicating the size of the XTEN) and "Fc" in each box in the table below the X-axis indicate which moiety is inserted within or fused to the C-terminus of the FIX polypeptide.

FIG. 6A provides a graph depicting the plasma percentile of dosed FIX clotting activities against time of various FIX fusion proteins with XTEN fusions of various length inserted into the activation peptide (AP) domain (e.g., FIXFc-AP.72 and FIXFc-AP.42) or EGF2 domain (e.g., FIXFc-EGF.42) compared to rFIX and rFIXFc, as measured after single bolus intravenous dosing in hemophilia-B mice. FIG. 6B provides a graphical compilation of the calculated pharmacokinetic parameters of a single intravenous bolus dosed FIX fusion proteins shown in FIG. 6A. Indicated on the Y-axis is percentile of plasma activity recovery for each of the indicated molecules. The X-axis shows the calculated mean residence time (MRT, in hours). The area of the dots represents the relative calculated area under the curve per dose (AUC/D, in h/kg/mL).

FIG. 7A provides a graph depicting the plasma percentile of dosed FIX clotting activities against time of a FIX fusion protein comprising an thrombin-cleavable XTEN of 288 amino acids fused to the C terminus of a FIX polypeptide (rFIX-CT.288), a FIX fusion protein comprising an XTEN of 72 amino acids inserted within the AP domain of a FIX polypeptide (rFIXFc-AP.72), and a FIX fusion protein comprising an XTEN of 42 amino acids inserted within the EGF2 domain of a FIX polypeptide (rFIXFc-EGF2.42) compared to rFIX and rFIXFc, as measured after single bolus subcutaneous dosing in hemophilia-B mice. FIG. 7B provides a graphical compilation of the calculated pharmacokinetic parameters of a single subcutaneous bolus dosed FIX fusion proteins shown in FIG. 7A. Indicated on the Y-axis is percentile of bioavailability for each of the indicated molecules. The X-axis shows the calculated mean residence time (MRT, in hours). The area of the dots represents the relative calculated area under the curve per dose (AUC/D, in h/kg/mL).

FIG. 8A provides a graphical depiction of clotting time in seconds measured by rotational thromboelastometry (ROTEM) of rFIXFc and a FIX fusion protein comprising an XTEN of 72 amino acids inserted within the AP domain of FIX (e.g., rFIXFc-AP-XTEN.72) in human hemophilia B blood. FIG. 8B provides a graphical depiction of alpha angle in degrees of rFIXFc and a FIX fusion protein (e.g., rFIXFc-AP-XTEN.72) in human hemophilia B blood. FIG. 8C provides a graphical depiction of maximum clot firmness (MCF) in mm of rFIXFc and a FIX fusion protein (e.g., rFIXFc-AP-XTEN.72) in human hemophilia B blood.

FIG. 13 is a table summarizing the FIX-XTEN constructs as used in the examples with matching sequence identification number, description and plasmid code.

DETAILED DESCRIPTION

Figure 3A:
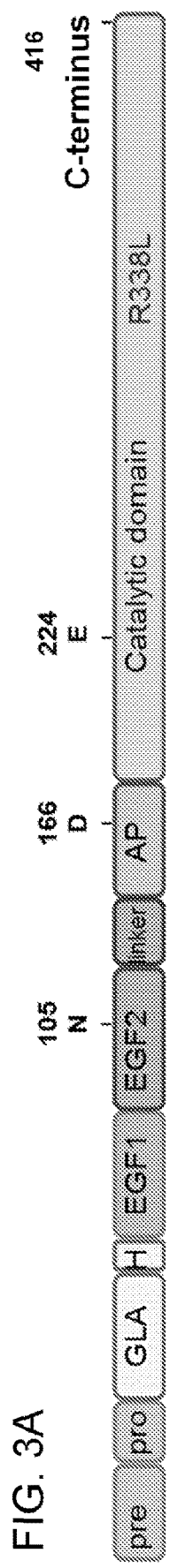
FIG. 3A is a schematic representation of the regions and domains of the R338L FIX variant. Specific amino acid residues (e.g., N105, D166, and E224) and the C-terminus are highlighted as potential heterologous moiety, e.g., XTEN, insertion sites.
Figure 3B:
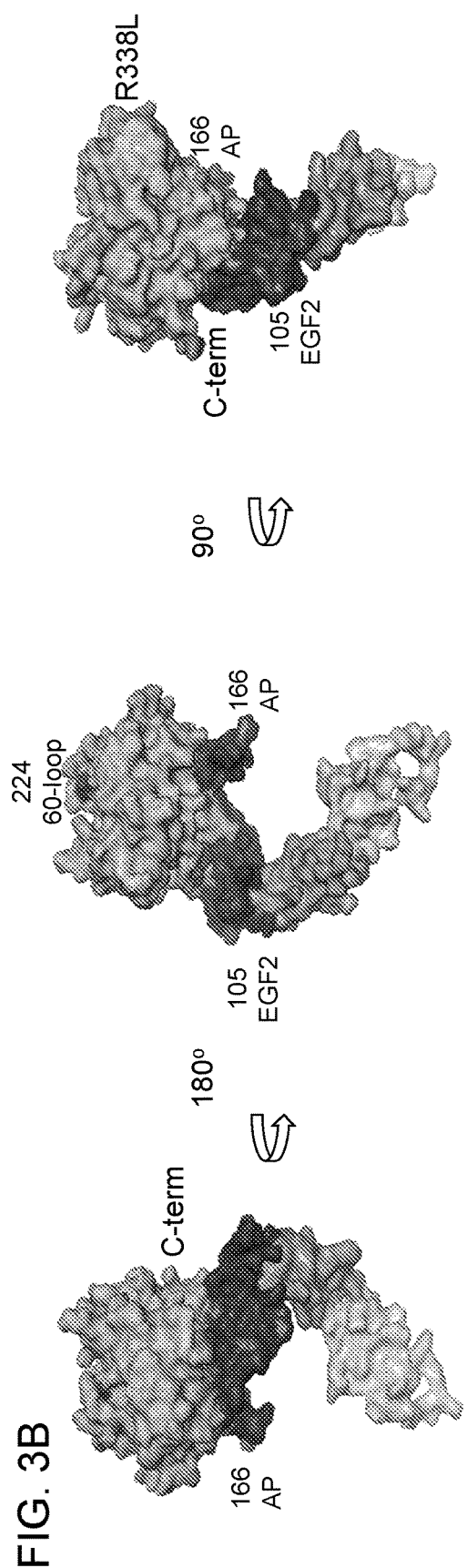
FIG. 3B shows illustrations of the three-dimensional structure of the porcine FIX (PDB:1PFX) from three different angles. The insertion sites N105, D166, and E224, the C-terminus, and the location of the R338L mutation (e.g., in the R338L FIX variant) are labeled.

This disclosure provides a FIX fusion protein comprising a FIX polypeptide and at least one heterologous moiety and methods of making and using the same. In certain aspects, the FIX fusion protein comprises at least one heterologous moiety inserted within the FIX polypeptide, fused to the C-terminus of the FIX polypeptide, or both, wherein the FIX fusion protein exhibits procoagulant activity. In a particular aspect, the heterologous moiety is XTEN.

I. Definitions

Throughout this disclosure, the term "a" or "an" entity refers to one or more of that entity; for example, "a polynucleotide," is understood to represent one or more polynucleotides. As such, the terms "a" (or "an"), "one or more," and "at least one" can be used interchangeably herein.

Furthermore, "and/or" where used herein is to be taken as specific disclosure of each of the two specified features or components with or without the other. Thus, the term "and/or" as used in a phrase such as "A and/or B" herein is intended to include "A and B," "A or B," "A" (alone), and "B" (alone). Likewise, the term "and/or" as used in a phrase such as "A, B, and/or C" is intended to encompass each of the following aspects: A, B, and C; A, B, or C; A or C; A or B; B or C; A and C; A and B; B and C; A (alone); B (alone); and C (alone).

It is understood that wherever aspects are described herein with the language "comprising," otherwise analogous aspects described in terms of "consisting of" and/or "consisting essentially of" are also provided.

Unless defined otherwise, all technical and scientific terms used herein have the same meaning as commonly understood by one of ordinary skill in the art to which this disclosure is related. For example, the Concise Dictionary of Biomedicine and Molecular Biology, Juo, Pei-Show, 2nd ed., 2002, CRC Press; The Dictionary of Cell and Molecular Biology, 3rd ed., 1999, Academic Press; and the Oxford Dictionary Of Biochemistry And Molecular Biology, Revised, 2000, Oxford University Press, provide one of skill with a general dictionary of many of the terms used in this disclosure.

Units, prefixes, and symbols are denoted in their Systeme International de Unites (SI) accepted form. Numeric ranges are inclusive of the numbers defining the range. Unless otherwise indicated, amino acid sequences are written left to right in amino to carboxy orientation. The headings provided herein are not limitations of the various aspects of the disclosure, which can be had by reference to the specification as a whole. Accordingly, the terms defined immediately below are more fully defined by reference to the specification in its entirety.

The term "about" is used herein to mean approximately, roughly, around, or in the regions of When the term "about" is used in conjunction with a numerical range, it modifies that range by extending the boundaries above and below the numerical values set forth. In general, the term "about" can modify a numerical value above and below the stated value by a variance of, e.g., 10 percent, up or down (higher or lower).

The term "polynucleotide" or "nucleotide" is intended to encompass a singular nucleic acid as well as plural nucleic acids, and refers to an isolated nucleic acid molecule or construct, e.g., messenger RNA (mRNA) or plasmid DNA (pDNA). In certain embodiments, a polynucleotide comprises a conventional phosphodiester bond or a non-conventional bond (e.g., an amide bond, such as found in peptide nucleic acids (PNA)). The term "nucleic acid" refers to any one or more nucleic acid segments, e.g., DNA or RNA fragments, present in a polynucleotide. By "isolated" nucleic acid or polynucleotide is intended a nucleic acid molecule, DNA or RNA, which has been removed from its native environment. For example, a recombinant polynucleotide encoding a FIX polypeptide contained in a vector is considered isolated for the purposes of the present invention. Further examples of an isolated polynucleotide include recombinant polynucleotides maintained in heterologous host cells or purified (partially or substantially) from other polynucleotides in a solution. Isolated RNA molecules include in vivo or in vitro RNA transcripts of polynucleotides of the present invention. Isolated polynucleotides or nucleic acids according to the present invention further include such molecules produced synthetically. In addition, a polynucleotide or a nucleic acid can include regulatory elements such as promoters, enhancers, ribosome binding sites, or transcription termination signals.

As used herein, a "coding region" or "coding sequence" is a portion of polynucleotide, which consists of codons translatable into amino acids. Although a "stop codon" (TAG, TGA, or TAA) is typically not translated into an amino acid, it may be considered to be part of a coding region, but any flanking sequences, for example promoters, ribosome binding sites, transcriptional terminators, introns, and the like, are not part of a coding region. The boundaries of a coding region are typically determined by a start codon at the 5' terminus, encoding the amino terminus of the resultant polypeptide, and a translation stop codon at the 3' terminus, encoding the carboxyl terminus of the resulting polypeptide. Two or more coding regions of the present invention can be present in a single polynucleotide construct, e.g., on a single vector, or in separate polynucleotide constructs, e.g., on separate (different) vectors. It follows, then, that a single vector can contain just a single coding region, or comprise two or more coding regions, e.g., a single vector can separately encode a binding domain-A and a binding domain-B as described below. In addition, a vector, polynucleotide, or nucleic acid of the invention can encode heterologous coding regions, either fused or unfused to a nucleic acid encoding a binding domain of the invention. Heterologous coding regions include without limitation specialized elements or motifs, such as a secretory signal peptide or a heterologous functional domain.

Certain proteins secreted by mammalian cells are associated with a secretory signal peptide, which is cleaved from the mature protein once export of the growing protein chain across the rough endoplasmic reticulum has been initiated. Those of ordinary skill in the art are aware that signal peptides are generally fused to the N-terminus of the polypeptide, and are cleaved from the complete or "full-length" polypeptide to produce a secreted or "mature" form of the polypeptide. In certain embodiments, a native signal peptide or a functional derivative of that sequence that retains the ability to direct the secretion of the polypeptide that is operably associated with it. Alternatively, a heterologous mammalian signal peptide, e.g., a human tissue plasminogen activator (TPA) or mouse B-glucuronidase signal peptide, or a functional derivative thereof, can be used.

The term "downstream" refers to a nucleotide sequence that is located 3' to a reference nucleotide sequence. In certain embodiments, downstream nucleotide sequences relate to sequences that follow the starting point of transcription. For example, the translation initiation codon of a gene is located downstream of the start site of transcription. "Downstream" can also refer to a peptide sequence that is located C-terminal to a reference peptide sequence.

The term "upstream" refers to a nucleotide sequence that is located 5' to a reference nucleotide sequence. In certain embodiments, upstream nucleotide sequences relate to sequences that are located on the 5' side of a coding region or starting point of transcription. For example, most promoters are located upstream of the start site of transcription. "Upstream" can also refer to a peptide sequence that is located N-terminal to a reference peptide sequence.

As used herein, the term "regulatory region" refers to nucleotide sequences located upstream (5' non-coding sequences), within, or downstream (3' non-coding sequences) of a coding region, and which influence the transcription, RNA processing, stability, or translation of the associated coding region. Regulatory regions may include promoters, translation leader sequences, introns, polyadenylation recognition sequences, RNA processing sites, effector binding sites and stem-loop structures. If a coding region is intended for expression in a eukaryotic cell, a polyadenylation signal and transcription termination sequence will usually be located 3' to the coding sequence.

A polynucleotide, which encodes a gene product, e.g., a polypeptide, can include a promoter and/or other transcription or translation control elements operably associated with one or more coding regions. In an operable association a coding region for a gene product, e.g., a polypeptide, is associated with one or more regulatory regions in such a way as to place expression of the gene product under the influence or control of the regulatory region(s). For example, a coding region and a promoter are "operably associated" if induction of promoter function results in the transcription of mRNA encoding the gene product encoded by the coding region, and if the nature of the linkage between the promoter and the coding region does not interfere with the ability of the promoter to direct the expression of the gene product or interfere with the ability of the DNA template to be transcribed. Other transcription control elements, besides a promoter, for example enhancers, operators, repressors, and transcription termination signals, can also be operably associated with a coding region to direct gene product expression.

A variety of transcription control regions are known to those skilled in the art. These include, without limitation, transcription control regions, which function in vertebrate cells, such as, but not limited to, promoter and enhancer segments from cytomegaloviruses (the immediate early promoter, in conjunction with intron-A), simian virus 40 (the early promoter), and retroviruses (such as Rous sarcoma virus). Other transcription control regions include those derived from vertebrate genes such as actin, heat shock protein, bovine growth hormone and rabbit B-globin, as well as other sequences capable of controlling gene expression in eukaryotic cells. Additional suitable transcription control regions include tissue-specific promoters and enhancers as well as lymphokine-inducible promoters (e.g., promoters inducible by interferons or interleukins).

Similarly, a variety of translation control elements are known to those of ordinary skill in the art. These include, but are not limited to ribosome binding sites, translation initiation and termination codons, and elements derived from picornaviruses (particularly an internal ribosome entry site, or IRES, also referred to as a CITE sequence).

The term "expression" as used herein refers to a process by which a polynucleotide produces a gene product, for example, an RNA or a polypeptide. It includes without limitation transcription of the polynucleotide into messenger RNA (mRNA), transfer RNA (tRNA), small hairpin RNA (shRNA), small interfering RNA (siRNA) or any other RNA product, and the translation of an mRNA into a polypeptide. Expression produces a "gene product." As used herein, a gene product can be either a nucleic acid, e.g., a messenger RNA produced by transcription of a gene, or a polypeptide which is translated from a transcript. Gene products described herein further include nucleic acids with post transcriptional modifications, e.g., polyadenylation or splicing, or polypeptides with post translational modifications, e.g., methylation, glycosylation, the addition of lipids, association with other protein subunits, or proteolytic cleavage.

A "vector" refers to any vehicle for the cloning of and/or transfer of a nucleic acid into a host cell. A vector may be a replicon to which another nucleic acid segment may be attached so as to bring about the replication of the attached segment. A "replicon" refers to any genetic element (e.g., plasmid, phage, cosmid, chromosome, virus) that functions as an autonomous unit of replication in vivo, i.e., capable of replication under its own control. The term "vector" includes both viral and nonviral vehicles for introducing the nucleic acid into a cell in vitro, ex vivo or in vivo. A large number of vectors are known and used in the art including, for example, plasmids, modified eukaryotic viruses, or modified bacterial viruses. Insertion of a polynucleotide into a suitable vector can be accomplished by ligating the appropriate polynucleotide fragments into a chosen vector that has complementary cohesive termini.

Vectors may be engineered to encode selectable markers or reporters that provide for the selection or identification of cells that have incorporated the vector. Expression of selectable markers or reporters allows identification and/or selection of host cells that incorporate and express other coding regions contained on the vector. Examples of selectable marker genes known and used in the art include: genes providing resistance to ampicillin, streptomycin, gentamycin, kanamycin, hygromycin, neomycin, puromycin, bialaphos herbicide, sulfonamide, and the like; and genes that are used as phenotypic markers, i.e., anthocyanin regulatory genes, isopentanyl transferase gene, and the like. Examples of reporters known and used in the art include: luciferase (Luc), green fluorescent protein (GFP), chloramphenicol acetyltransferase (CAT), -galactosidase (LacZ), -glucuronidase (Gus), and the like. Selectable markers may also be considered to be reporters.

The term "plasmid" refers to an extra-chromosomal element often carrying a gene that is not part of the central metabolism of the cell, and usually in the form of circular double-stranded DNA molecules. Such elements may be autonomously replicating sequences, genome integrating sequences, phage or nucleotide sequences, linear, circular, or supercoiled, of a single- or double-stranded DNA or RNA, derived from any source, in which a number of nucleotide sequences have been joined or recombined into a unique construction which is capable of introducing a promoter fragment and DNA sequence for a selected gene product along with appropriate 3' untranslated sequence into a cell.

Eukaryotic viral vectors that can be used include, but are not limited to, adenovirus vectors, retrovirus vectors, adeno-associated virus vectors, and poxvirus, e.g., vaccinia virus vectors, baculovirus vectors, or herpesvirus vectors. Non-viral vectors include plasmids, liposomes, electrically charged lipids (cytofectins), DNA-protein complexes, and biopolymers.

A "cloning vector" refers to a "replicon," which is a unit length of a nucleic acid that replicates sequentially and which comprises an origin of replication, such as a plasmid, phage or cosmid, to which another nucleic acid segment may be attached so as to bring about the replication of the attached segment. Certain cloning vectors are capable of replication in one cell type, e.g., bacteria and expression in another, e.g., eukaryotic cells. Cloning vectors typically comprise one or more sequences that can be used for selection of cells comprising the vector and/or one or more multiple cloning sites for insertion of nucleic acid sequences of interest.

The term "expression vector" refers to a vehicle designed to enable the expression of an inserted nucleic acid sequence following insertion into a host cell. The inserted nucleic acid sequence is placed in operable association with regulatory regions as described above.

Vectors are introduced into host cells by methods well known in the art, e.g., transfection, electroporation, microinjection, transduction, cell fusion, DEAE dextran, calcium phosphate precipitation, lipofection (lysosome fusion), use of a gene gun, or a DNA vector transporter.

"Culture," "to culture" and "culturing," as used herein, means to incubate cells under in vitro conditions that allow for cell growth or division or to maintain cells in a living state. "Cultured cells," as used herein, means cells that are propagated in vitro.

As used herein, the term "polypeptide" is intended to encompass a singular "polypeptide" as well as plural "polypeptides," and refers to a molecule composed of monomers (amino acids) linearly linked by amide bonds (also known as peptide bonds). The term "polypeptide" refers to any chain or chains of two or more amino acids, and does not refer to a specific length of the product. Thus, peptides, dipeptides, tripeptides, oligopeptides, "protein," "amino acid chain," or any other term used to refer to a chain or chains of two or more amino acids, are included within the definition of "polypeptide," and the term "polypeptide" can be used instead of, or interchangeably with any of these terms. The term "polypeptide" is also intended to refer to the products of post-expression modifications of the polypeptide, including without limitation glycosylation, acetylation, phosphorylation, amidation, derivatization by known protecting/blocking groups, proteolytic cleavage, or modification by non-naturally occurring amino acids. A polypeptide can be derived from a natural biological source or produced recombinant technology, but is not necessarily translated from a designated nucleic acid sequence. It can be generated in any manner, including by chemical synthesis.

An "isolated" polypeptide or a fragment, variant, or derivative thereof refers to a polypeptide that is not in its natural milieu. No particular level of purification is required. For example, an isolated polypeptide can simply be removed from its native or natural environment. Recombinantly produced polypeptides and proteins expressed in host cells are considered isolated for the purpose of the invention, as are native or recombinant polypeptides which have been separated, fractionated, or partially or substantially purified by any suitable technique.

As used herein, the term "host cell" refers to a cell or a population of cells harboring or capable of harboring a recombinant nucleic acid. Host cells can be a prokaryotic cells (e.g., *E. coli*), or alternatively, the host cells can be eukaryotic, for example, fungal cells (e.g., yeast cells such as *Saccharomyces cerevisiae*, *Pichia pastoris*, or *Schizosaccharomyces pombe*), and various animal cells, such as insect cells (e.g., Sf-9) or mammalian cells (e.g., HEK293F, CHO, COS-7, NIH-3T3).

Also included in the present invention are fragments or variants of polypeptides, and any combination thereof. The term "fragment" or "variant" when referring to polypeptide binding domains or binding molecules of the present invention include any polypeptides which retain at least some of the properties (e.g., FcRn binding affinity for an FcRn binding domain or Fc variant, or coagulation activity for a FIX variant) of the reference polypeptide. Fragments of polypeptides include proteolytic fragments, as well as deletion fragments, in addition to specific antibody fragments discussed elsewhere herein, but do not include the naturally occurring full-length polypeptide (or mature polypeptide). Variants of polypeptide binding domains or binding molecules of the present invention include fragments as described above, and also polypeptides with altered amino acid sequences due to amino acid substitutions, deletions, or insertions. Variants can be naturally or non-naturally occurring. Non-naturally occurring variants can be produced using art-known mutagenesis techniques. Variant polypeptides can comprise conservative or non-conservative amino acid substitutions, deletions or additions. One particular FIX variant disclosed herein is the R338L FIX (Padua) variant (SEQ ID NO: 2). See, e.g., Simioni, P., et al., "X-Linked Thrombophilia with a Mutant Factor IX (Factor IX Padua)," *NEJM* 361:1671-75 (October 2009), which is incorporated by reference herein in its entirety.

A "conservative amino acid substitution" is one in which the amino acid residue is replaced with an amino acid residue having a similar side chain. Families of amino acid residues having similar side chains have been defined in the art, including basic side chains (e.g., lysine, arginine, histidine), acidic side chains (e.g., aspartic acid, glutamic acid), uncharged polar side chains (e.g., glycine, asparagine, glutamine, serine, threonine, tyrosine, cysteine), nonpolar side chains (e.g., alanine, valine, leucine, isoleucine, proline, phenylalanine, methionine, tryptophan), beta-branched side chains (e.g., threonine, valine, isoleucine) and aromatic side chains (e.g., tyrosine, phenylalanine, tryptophan, histidine). Thus, if an amino acid in a polypeptide is replaced with another amino acid from the same side chain family, the substitution is considered to be conservative. In another embodiment, a string of amino acids can be conservatively replaced with a structurally similar string that differs in order and/or composition of side chain family members.

The term "percent sequence identity" between two polynucleotide or polypeptide sequences refers to the number of identical matched positions shared by the sequences over a comparison window, taking into account additions or deletions (i.e., gaps) that must be introduced for optimal alignment of the two sequences. A matched position is any position where an identical nucleotide or amino acid is presented in both the target and reference sequence. Gaps presented in the target sequence are not counted since gaps are not nucleotides or amino acids. Likewise, gaps presented in the reference sequence are not counted since target sequence nucleotides or amino acids are counted, not nucleotides or amino acids from the reference sequence.

The percentage of sequence identity is calculated by determining the number of positions at which the identical amino-acid residue or nucleic acid base occurs in both sequences to yield the number of matched positions, dividing the number of matched positions by the total number of positions in the window of comparison and multiplying the result by 100 to yield the percentage of sequence identity. The comparison of sequences and determination of percent sequence identity between two sequences may be accomplished using readily available software both for online use and for download. Suitable software programs are available from various sources, and for alignment of both protein and nucleotide sequences. One suitable program to determine percent sequence identity is bl2seq, part of the BLAST suite of programs available from the U.S. government's National Center for Biotechnology Information BLAST web site (blast.ncbi.nlm.nih.gov). Bl2seq performs a comparison between two sequences using either the BLASTN or BLASTP algorithm. BLASTN is used to compare nucleic acid sequences, while BLASTP is used to compare amino acid sequences. Other suitable programs are, e.g., Needle, Stretcher, Water, or Matcher, part of the EMBOSS suite of bioinformatics programs and also available from the European Bioinformatics Institute (EBI) at www.ebi.ac.uk/Tools/psa.

Different regions within a single polynucleotide or polypeptide target sequence that aligns with a polynucleotide or polypeptide reference sequence can each have their own percent sequence identity. It is noted that the percent sequence identity value is rounded to the nearest tenth. For example, 80.11, 80.12, 80.13, and 80.14 are rounded down to 80.1, while 80.15, 80.16, 80.17, 80.18, and 80.19 are rounded up to 80.2. It also is noted that the length value will always be an integer.

One skilled in the art will appreciate that the generation of a sequence alignment for the calculation of a percent sequence identity is not limited to binary sequence-sequence comparisons exclusively driven by primary sequence data. Sequence alignments can be derived from multiple sequence alignments. One suitable program to generate multiple sequence alignments is ClustalW2, available from www.clustal.org. Another suitable program is MUSCLE, available from www.drive5.com/muscle/. ClustalW2 and MUSCLE are alternatively available, e.g., from the EBI.

It will also be appreciated that sequence alignments can be generated by integrating sequence data with data from heterogeneous sources such as structural data (e.g., crystallographic protein structures), functional data (e.g., location of mutations), or phylogenetic data. A suitable program that integrates heterogeneous data to generate a multiple sequence alignment is T-Coffee, available at www.tcoffee.org, and alternatively available, e.g., from the EBI. It will also be appreciated that the final alignment used to calculate percent sequence identity may be curated either automatically or manually.

As used herein, an "amino acid corresponding to," "site corresponding to," or "equivalent amino acid" in a Factor IX protein sequence is identified by alignment to maximize the identity or similarity between a first FIX sequence and a second FIX sequence. The number used to identify an equivalent amino acid in a second FIX sequence is based on the number used to identify the corresponding amino acid in the first FIX sequence.

As used herein, the term "insertion site" refers to an amino acid residue number in aFIX polypeptide (typically a mature FIX polypeptide), or fragment, variant, or derivative thereof, which is immediately upstream of the position at which a heterologous moiety can be inserted. An "insertion site" is specified as a number, the number being the number of the amino acid in the R338L FIX (Padua) variant (SEQ ID NO: 2) to which the insertion site corresponds, which is immediately N-terminal to the position of the insertion. For example, the phrase "the EGF2 domain comprises an XTEN at an insertion site which corresponds to amino acid 105 of SEQ ID NO: 2" indicates that the heterologous moiety is located between two amino acids corresponding to amino acid 105 and amino acid 106 of SEQ ID NO: 2. However, one of skill in the art would readily be able to identify a corresponding position in any FIX variant, and the present disclosure is not limited to insertions made solely in the R338L FIX (Padua) variant. Rather, the insertions disclosed herein can be made in any FIX variant or fragment thereof having procoagulant activity at a position corresponding to a position of the R338L FIX variant.

The phrase "immediately downstream of an amino acid" as used herein refers to position right next to the terminal carboxyl group of the amino acid. Similarly, the phrase "immediately upstream of an amino acid" refers to the position right next to the terminal amine group of the amino acid. Therefore, the phrase "between two amino acids of an insertion site" as used herein refers to a position in which an XTEN or any other polypeptide is inserted between two adjacent amino acids.

The terms "inserted," "is inserted," "inserted into" or grammatically related terms, as used herein refers to the position of an XTEN in a fusion polypeptide relative to the analogous position in the R338L FIX (Padua) variant (SEQ ID NO: 2). Those of skill in the field will understand how to identify corresponding insertion positions with respect to other FIX polypeptide sequences such as that shown as SEQ ID NO:1. As used herein the terms refer to the characteristics of the recombinant FIX polypeptide relative to the R338L FIX (Padua) variant, and do not indicate, imply or infer any methods or process by which the fusion polypeptide was made. For example, in reference to a fusion polypeptide provided herein, the phrase "an XTEN is inserted into the EGF2 domain immediately downstream of residue 105 of the FIX polypeptide" means that the fusion polypeptide comprises an XTEN immediately downstream of an amino acid which corresponds to amino acid 105 in the R338L FIX variant (SEQ ID NO: 2), e.g., bounded by amino acids corresponding to amino acids 105 and 106 of the R338L FIX variant.

A "fusion" or "chimeric" protein comprises a first amino acid sequence linked to a second amino acid sequence with which it is not naturally linked in nature. The amino acid sequences which normally exist in separate proteins can be brought together in the fusion polypeptide, or the amino acid sequences which normally exist in the same protein can be placed in a new arrangement in the fusion polypeptide, e.g., fusion of a FIX domain of the invention with an Ig Fc domain. A fusion protein is created, for example, by chemical synthesis, or by creating and translating a polynucleotide in which the peptide regions are encoded in the desired relationship. A fusion protein can further comprise a second amino acid sequence associated with the first amino acid sequence by a covalent, non-peptide bond or a non-covalent bond.

The terms "heterologous" and "heterologous moiety" mean that a polynucleotide, polypeptide, or other moiety is derived from a distinct entity from that of the entity to which it is being compared. For instance, a heterologous polypeptide can be synthetic, or derived from a different species, different cell type of an individual, or the same or different type of cell of distinct individuals. In one aspect, a heterologous moiety is a polypeptide fused to another polypeptide to produce a fusion polypeptide or protein. In another aspect, a heterologous moiety is a non-polypeptide such as PEG conjugated to a polypeptide or protein.

As used herein, the term "half-life" refers to a biological half-life of a particular polypeptide in vivo. Half-life may be represented by the time required for half the quantity administered to a subject to be cleared from the circulation and/or other tissues in the animal. When a clearance curve of a given polypeptide is constructed as a function of time, the curve is usually biphasic with a rapid a-phase and longer β-phase. The α-phase typically represents an equilibration of the administered polypeptide between the intra- and extra-vascular space and is, in part, determined by the size of the polypeptide. The β-phase typically represents the catabolism of the polypeptide in the intravascular space. In some embodiments, FIX and fusion proteins comprising FIX are monophasic, and thus do not have an alpha phase, but just the single beta phase. Therefore, in certain embodiments, the term half-life as used herein refers to the half-life of the polypeptide in the β-phase. The typical β-phase half-life of a human antibody in humans is 21 days.

The terms "linked" and "fused" as used herein refers to a first amino acid sequence or nucleotide sequence covalently or non-covalently joined to a second amino acid sequence or nucleotide sequence, respectively. The first amino acid or nucleotide sequence can be directly joined or juxtaposed to the second amino acid or nucleotide sequence or alternatively an intervening sequence can covalently join the first sequence to the second sequence. The term "linked" means not only a fusion of a first amino acid sequence to a second amino acid sequence at the C-terminus or the N-terminus, but also includes insertion of the whole first amino acid sequence (or the second amino acid sequence) into any two amino acids in the second amino acid sequence (or the first amino acid sequence, respectively). In one embodiment, the first amino acid sequence is linked to a second amino acid sequence by a peptide bond or a linker. The first nucleotide sequence can be linked to a second nucleotide sequence by a phosphodiester bond or a linker. The linker can be a peptide or a polypeptide (for polypeptide chains) or a nucleotide or a nucleotide chain (for nucleotide chains) or any chemical moiety (for both polypeptide and polynucleotide chains). The term "linked" is also indicated by a hyphen (-).

As used herein the term "associated with" refers to a covalent or non-covalent bond formed between a first amino acid chain and a second amino acid chain. In one embodiment, the term "associated with" means a covalent, non-peptide bond or a non-covalent bond. This association can be indicated by a colon, i.e., (:). In another embodiment, it means a covalent bond except a peptide bond. For example, the amino acid cysteine comprises a thiol group that can form a disulfide bond or bridge with a thiol group on a second cysteine residue. In most naturally occurring IgG molecules, the CH1 and CL regions are associated by a disulfide bond and the two heavy chains are associated by two disulfide bonds at positions corresponding to 239 and 242 using the Kabat numbering system (position 226 or 229, EU numbering system). Examples of covalent bonds include, but are not limited to, a peptide bond, a metal bond, a hydrogen bond, a disulfide bond, a sigma bond, a pi bond, a delta bond, a glycosidic bond, an agnostic bond, a bent bond, a dipolar bond, a Pi backbond, a double bond, a triple bond, a quadruple bond, a quintuple bond, a sextuple bond, conjugation, hyperconjugation, aromaticity, hapticity, or antibonding. Non-limiting examples of non-covalent bond include an ionic bond (e.g., cation-pi bond or salt bond), a metal bond, an hydrogen bond (e.g., dihydrogen bond, dihydrogen complex, low-barrier hydrogen bond, or symmetric hydrogen bond), van der Walls force, London dispersion force, a mechanical bond, a halogen bond, aurophilicity, intercalation, stacking, entropic force, or chemical polarity.

As used herein, the term "cleavage site" or "enzymatic cleavage site" refers to a site recognized by an enzyme. Certain enzymatic cleavage sites comprise an intracellular processing site. In one embodiment, a polypeptide has an enzymatic cleavage site cleaved by an enzyme that is activated during the clotting cascade, such that cleavage of such sites occurs at the site of clot formation. Exemplary such sites include, e.g., those recognized by thrombin, Factor XIa or Factor Xa. Exemplary FXIa cleavage sites include, e.g., TQSFNDFTR (SEQ ID NO: 166) and SVSQTSKLTR (SEQ ID NO: 167). Exemplary thrombin cleavage sites include, e.g., DFLAEGGGVR (SEQ ID NO: 168), TTKIKPR (SEQ ID NO: 169), LVPRG (SEQ ID NO: 170) and ALRPR (SEQ ID NO: 171). Other enzymatic cleavage sites are known in the art.

As used herein, the term "processing site" or "intracellular processing site" refers to a type of enzymatic cleavage site in a polypeptide which is a target for enzymes that function after translation of the polypeptide. In one embodiment, such enzymes function during transport from the Golgi lumen to the trans-Golgi compartment. Intracellular processing enzymes cleave polypeptides prior to secretion of the protein from the cell. Examples of such processing sites include, e.g., those targeted by the PACE/furin (where PACE is an acronym for Paired basic Amino acid Cleaving Enzyme) family of endopeptidases. These enzymes are localized to the Golgi membrane and cleave proteins on the carboxyterminal side of the sequence motif Arg-[any residue]-(Lys or Arg)-Arg. As used herein the "furin" family of enzymes includes, e.g., PCSK1 (also known as PC1/Pc3), PCSK2 (also known as PC2), PCSK3 (also known as furin or PACE), PCSK4 (also known as PC4), PCSK5 (also known as PC5 or PC6), PCSK6 (also known as PACE4), or PCSK7 (also known as PC7/LPC, PC8, or SPC7). Other processing sites are known in the art. The term "processable linker" referred to herein means a linker comprising an intracellular processing site.

In constructs that include more than one processing or cleavage site, it will be understood that such sites may be the same or different.

A "processable linker" as used herein refers to a linker comprising at least one intracellular processing site, which is described elsewhere herein.

"Baseline," as used herein, is the lowest measured plasma FIX level in a subject prior to administering a dose. The FIX plasma levels can be measured at two time points prior to dosing: at a screening visit and immediately prior to dosing. Alternatively, (a) the baseline in subjects whose pretreatment FIX activity is <1%, who have no detectable FIX antigen, and have nonsense genotypes can be defined as 0%, (b) the baseline for subjects with pretreatment FIX activity<1% and who have detectable FIX antigen can be set at 0.5%, (c) the baseline for subjects whose pretreatment FIX activity is between 1-2% is Cmin (the lowest activity throughout the PK study), and (d) the baseline for subjects whose pretreatment FIX activity is ≥2% can be set at 2%.

"Subject," as used herein means a human. Subject as used herein includes an individual who is known to have at least one incidence of uncontrolled bleeding episodes, who has been diagnosed with a disease or disorder associated with uncontrolled bleeding episodes, e.g., a bleeding disease or disorder, e.g., hemophilia B, who are susceptible to uncontrolled bleeding episodes, e.g., hemophilia, or any combinations thereof. Subjects can also include an individual who is in danger of one or more uncontrollable bleeding episodes prior to a certain activity, e.g., a surgery, a sport activity, or any strenuous activities. The subject can have a baseline FIX activity less than 1%, less than 0.5%, less than 2%, less than 2.5%, less than 3%, or less than 4%. Subjects also include pediatric humans. Pediatric human subjects are birth to 20 years, preferably birth to 18 years, birth to 16 years, birth to 15 years, birth to 12 years, birth to 11 years, birth to 6 years, birth to 5 years, birth to 2 years, and 2 to 11 years of age.

Treat, treatment, treating, as used herein refers to, e.g., the reduction in severity of a disease or condition; the reduction in the duration of a disease course; the amelioration of one or more symptoms associated with a disease or condition; the provision of beneficial effects to a subject with a disease or condition, without necessarily curing the disease or condition, or the prophylaxis of one or more symptoms associated with a disease or condition. In one embodiment, the term "treating" or "treatment" means maintaining a FIX trough level at least about 1 IU/dL, 2 IU/dL, 3 IU/dL, 4 IU/dL, 5 IU/dL, 6 IU/dL, 7 IU/dL, 8 IU/dL, 9 IU/dL, 10 IU/dL, 11 IU/dL, 12 IU/dL, 13 IU/dL, 14 IU/dL, 15 IU/dL, 16 IU/dL, 17 IU/dL, 18 IU/dL, 19 IU/dL, or 20 IU/dL in a subject by administering a fusion protein of the invention. In another embodiment, treating or treatment means maintaining a FIX trough level between about 1 and about 20 IU/dL, about 2 and about 20 IU/dL, about 3 and about 20 IU/dL, about 4 and about 20 IU/dL, about 5 and about 20 IU/dL, about 6 and about 20 IU/dL, about 7 and about 20 IU/dL, about 8 and about 20 IU/dL, about 9 and about 20 IU/dL, or about 10 and about 20 IU/dL. Treatment or treating of a disease or condition can also include maintaining FIX activity in a subject at a level comparable to at least about 1%, 2%, 3%, 4%, 5%, 6%, 7%, 8%, 9%, 10%, 11%, 12%, 13%, 14%, 15%, 16%, 17%, 18%, 19%, or 20% of the FIX activity in a non-hemophiliac subject. The minimum trough level required for treatment can be measured by one or more known methods and can be adjusted (increased or decreased) for each person.

Hemostatic disorder, as used herein, means a genetically inherited or acquired condition characterized by a tendency to hemorrhage, either spontaneously or as a result of trauma, due to an impaired ability or inability to form a fibrin clot. Examples of such disorders include the hemophilias. The three main forms are hemophilia A (Factor VIII deficiency), hemophilia B (Factor IX deficiency or "Christmas disease") and hemophilia C (Factor XI deficiency, mild bleeding tendency). Other hemostatic disorders include, e.g., Von Willebrand disease, Factor XI deficiency (PTA deficiency), Factor XII deficiency, deficiencies or structural abnormalities in fibrinogen, prothrombin, Factor V, Factor VII, Factor X or Factor XIII, Bernard-Soulier syndrome, which is a defect or deficiency in GPIb. GPIb, the receptor for VWF, can be defective and lead to lack of primary clot formation (primary hemostasis) and increased bleeding tendency), and thrombasthenia of Glanzman and Naegeli (Glanzmann thrombasthenia). In liver failure (acute and chronic forms), there is insufficient production of coagulation factors by the liver; this may increase bleeding risk.

As used herein the term "acute bleeding" refers to a bleeding episode regardless of the underlying cause. For example, a subject may have trauma, uremia, a hereditary bleeding disorder (e.g., Factor VII deficiency) a platelet disorder, or resistance owing to the development of antibodies to clotting factors.

II. Fix Fusion Proteins

The present invention is directed to a FIX fusion protein comprising a FIX polypeptide and at least one heterologous moiety inserted within the FIX polypeptide, fused to the C-terminus of the FIX polypeptide, or both. The FIX fusion protein, after the insertion of or the fusion to the heterologous moiety, can retain one or more FIX activities. In one embodiment, the FIX activity is a procoagulant activity. The term "procoagulant activity" is meant the ability of the FIX protein of the invention to participate in the clotting cascade in blood, substituting for native FIX. For example, a recombinant FIX protein of the invention has procoagulant activity when it can convert Factor X (FX) to activated Factor X (FXa) in the presence of Factor VIII (FVIII), as tested, e.g., in a chromogenic assay. In another embodiment, the FIX activity is an ability to generate a tenase complex. In other embodiments, the FIX activity is an ability to generate thrombin (or a clot).

A recombinant FIX protein of the invention need not exhibit 100% of the procoagulant activity of native mature human FIX. In fact, in certain aspects a heterologous moiety inserted into a FIX polypeptide of the invention can increase the half-life or stability of the protein significantly, such that lower activity is perfectly acceptable. Thus, in certain aspects, a FIX fusion protein of the invention has at least about 10%, about 20%, about 30%, about 40%, about 50%, about 60%, about 70%, about 80%, about 90% or about 100% of the procoagulant activity of native FIX. However in some invention embodiments, the, recombinant FIX protein of the invention could have greater than 100% of native FIX activity for proteins containing the FIX Padua R338L high activity variant, for example, at least about 105%, 110%, 120%, 130%, 140%, 150%, 160%, 170%, 180%, 190% or 200% or more of that activity.

Procoagulant activity can be measured by any suitable in vitro or in vivo assay. The activity of FIX can be measured either downstream of the coagulation cascade by monitoring the generation of a clot (clotting assays), or upstream by measuring directly the enzymatic activity of FX following activation by the FVIII-FIX complex (chromogenic assays) (see, e.g., Barrowcliffe et al., *Semin. Thromb. Haemost.* 28:

247-56 (2002); Lee et al., *Thromb. Haemost.* 82: 1644-47 (1999); Lippi et al., *Clin. Chem. Lab. Med.* 45: 2-12 (2007); Matsumoto et al., *J. Thromb. Haemost.* 4: 377-84 (2006)). Thus, procoagulant activity can be measured using a chromogenic substrate assay, a clotting assay (e.g., a one stage or a two stage clotting assay), or both. The chromogenic assay mechanism is based on the principles of the blood coagulation cascade, where activated FIX converts FX into $FX_a$ in the presence of FVIII, phospholipids and calcium ions. The $FX_a$ activity is assessed by hydrolysis of a p-nitroanilide (pNA) substrate specific to $FX_a$. The initial rate of release of p-nitroaniline measured at 405 nM is directly proportional to the $FX_a$ activity and thus to the FIX activity in the sample. The chromogenic assay is recommended by the Factor VIII and Factor IX Subcommittee of the Scientific and Standardization Committee (SSC) of the International Society on Thrombosis and Hemostasis (ISTH).

Other suitable assays useful to determine pro-coagulant activity include those disclosed, e.g., in U.S. Application Publication No. 2010/0022445 to Scheiflinger and Dockal, which is incorporated herein by reference in its entirety.

In certain aspects the procoagulant activity of a recombinant FIX protein of the invention is compared to native mature FIX, in certain aspects it is compared to an international standard.

The at least one heterologous moiety, as described in more detail below, can comprise any heterologous moiety or can be a moiety that can provide an improved property to the FIX protein. For example, in one aspect, a heterologous moiety useful for the invention can be a moiety that is capable of extending a half-life of the FIX protein or a moiety that is capable of improving stability of the FIX protein. The FIX fusion protein of the invention can have more than one heterologous moieties inserted in or fused to the FIX polypeptide. In one embodiment, the more than one heterologous moieties are identical. In another embodiments, the more than one heterologous moieties are different. In other embodiments, the heterologous moiety is selected from the group consisting of an XTEN, an albumin, an albumin binding peptide, an albumin small binding molecule, an Fc domain, an FcRn binding partner, a PAS, a CTP, a PEG, an HES, a PSA, or any combination thereof.

In some embodiments, at least one heterologous moiety is inserted within a domain of the FIX polypeptide, but not between the domains. A FIX polypeptide comprises multiple domains, e.g., a y-carboxyglutamic acid (GLA) domain, an epidermal growth factor-like 1 (EGF1) domain, an epidermal growth factor-like 2 (EGF2) domain, an activation peptide (AP) domain, a linker between the EGF2 domain and the AP domain, and a catalytic domain (e.g., a serine protease domain). A FIX zymogen comprises 461 amino acids: amino acids 1-28 (corresponding to SEQ ID NO: 3) is a signal peptide; amino acids 29-46 (corresponding to SEQ ID NO: 3) is a propeptide; followed by the 415 amino acid FIX protein sequence. This 415 processed FIX comprises amino acids 1-145 (corresponding to SEQ ID NO: 1 or SEQ ID NO: 2) is a FIX light chain; amino acids 146-180 is an activation peptide; and amino acids 181 to 415 (corresponding to SEQ ID NO: 1 or SEQ ID NO: 2) is the catalytic FIX heavy chain. Within the light and heavy chains, the GLA domain corresponds to amino acids 1 to 46 of SEQ ID NO: 1 or SEQ ID NO: 2; the EGF1 domain corresponds to amino acids 47 to 84 of SEQ ID NO: 1 or SEQ ID NO: 2; the EGF2 domain corresponds to amino acids 85 to 127 of SEQ ID NO: 1 or SEQ ID NO: 2; the linker between the EGF2 domain and the AP domain corresponds to amino acids 128 to 145 of SEQ ID NO: 1 or SEQ ID NO: 2; the AP domain corresponds to amino acids 146 to 180 of SEQ ID NO: 1 or SEQ ID NO: 2; and the catalytic domain corresponds to amino acids 181 to 415 of SEQ ID NO: 1 or SEQ ID NO: 2

In certain embodiments, at least one heterologous moiety is inserted within one or more domains of a FIX polypeptide. For example, at least one heterologous moiety, e.g., XTEN, can be inserted within a domain selected from the group consisting of the GLA domain, the EGF1 domain, the EGF2 domain, the AP domain, the linker between the EGF2 domain and the AP domain, the catalytic domain, and any combination thereof. In one particular embodiment, the at least one heterologous moiety, e.g., XTEN, is inserted within the GLA domain, e.g., amino acids 1 to 46 of SEQ ID NO: 1 or SEQ ID NO: 2. In one particular embodiment, the at least one heterologous moiety, e.g., XTEN, is inserted within the EGF1 domain, e.g., amino acids 47 to 83 of SEQ ID NO: 1 or SEQ ID NO: 2. In one particular embodiment, the at least one heterologous moiety, e.g., XTEN, is inserted within the EGF2 domain, e.g., amino acids 84 to 125 of SEQ ID NO: 1 or SEQ ID NO: 2. In some embodiments, the at least one heterologous moiety, e.g., XTEN, is inserted within the linker between the EGF2 domain and the AP domain, e.g., amino acids 132 to 145 of SEQ ID NO: 1 or SEQ ID NO: 2. In one particular embodiment, the at least one heterologous moiety, e.g., XTEN, is inserted within the AP domain, e.g., amino acids 146 to 180 of SEQ ID NO: 1 or SEQ ID NO: 2. In some embodiments, the at least one heterologous moiety, e.g., XTEN, is inserted within the catalytic domain, e.g., amino acids 181 to 415 of SEQ ID NO: 1 or SEQ ID NO: 2.

In some embodiments, one or more heterologous moieties can be inserted within various insertion sites. In certain embodiments, the insertions of at least one heterologous moiety, e.g., an XTEN, at one or more of these sites do not result in a loss of FIX activity and/or induce an improved property of the FIX protein. For example, at least one heterologous moiety can be inserted within the FIX polypeptide at an insertion site corresponding to an amino acid selected from the group consisting of amino acid 103 of SEQ ID NO: 2 (i.e., immediately downstream of an amino acid corresponding to amino acid 103 of SEQ ID NO: 2), amino acid 105 of SEQ ID NO: 2 (i.e., immediately downstream of an amino acid corresponding to amino acid 105 of SEQ ID NO: 2), amino acid 142 of SEQ ID NO: 2 (i.e., immediately downstream of an amino acid corresponding to amino acid 142 of SEQ ID NO: 2), amino acid 149 of SEQ ID NO: 2 (i.e., immediately downstream of an amino acid corresponding to amino acid 149 of SEQ ID NO: 2), amino acid 162 of SEQ ID NO: 2 (i.e., immediately downstream of an amino acid corresponding to amino acid 162 of SEQ ID NO: 2), amino acid 166 of SEQ ID NO: 2 (i.e., immediately downstream of an amino acid corresponding to amino acid 166 of SEQ ID NO: 2), amino acid 174 of SEQ ID NO: 2 (i.e., immediately downstream of an amino acid corresponding to amino acid 174 of SEQ ID NO: 2), amino acid 224 of SEQ ID NO: 2 (i.e., immediately downstream of an amino acid corresponding to amino acid 224 of SEQ ID NO: 2), amino acid 226 of SEQ ID NO: 2 (i.e., immediately downstream of an amino acid corresponding to amino acid 226 of SEQ ID NO: 2), amino acid 228 of SEQ ID NO: 2 (i.e., immediately downstream of an amino acid corresponding to amino acid 228 of SEQ ID NO: 2), amino acid 413 of SEQ ID NO: 2 (i.e., immediately downstream of an amino acid corresponding to amino acid 413 of SEQ ID NO: 2) and any combination thereof, wherein the FIX fusion protein exhibits procoagulant activity.

In one embodiment, the heterologous moiety, e.g., XTEN, is inserted within the FIX polypeptide at an insertion site corresponding to an amino acid selected from the group consisting of amino acid 149 of SEQ ID NO: 1 or SEQ ID NO: 2, amino acid 162 of SEQ ID NO: 1 or SEQ ID NO: 2, amino acid 166 of SEQ ID NO: 1 or SEQ ID NO: 2, amino acid 174 of SEQ ID NO: 1 or SEQ ID NO: 2 and any combination thereof. In another embodiment, the heterologous moiety, e.g., XTEN, is inserted within the FIX polypeptide at an insertion site corresponding to an amino acid selected from the group consisting of amino acid 224 of SEQ ID NO: 1 or SEQ ID NO: 2, amino acid 226 of SEQ ID NO: 1 or SEQ ID NO: 2, amino acid 228 of SEQ ID NO: 1 or SEQ ID NO: 2, amino acid 413 of SEQ ID NO: 1 or SEQ ID NO: 2, and any combination thereof. In other embodiments, the heterologous moiety, e.g., XTEN, is inserted within the FIX polypeptide at an insertion site corresponding to an amino acid selected from the group consisting of amino acid 103 of SEQ ID NO: 1 or SEQ ID NO: 2, amino acid 105 of SEQ ID NO: 1 or SEQ ID NO: 2, and both. In another embodiment, the heterologous moiety, e.g., XTEN, is inserted within the FIX polypeptide at an insertion site corresponding to amino acid 142 of SEQ ID NO: 1 or SEQ ID NO: 2.

As discussed in more detail below, the heterologous moiety can be an XTEN, which can be of varying lengths. For example, the XTEN can comprise at least about 42 amino acids, at least about 72 amino acids, at least about 144 amino acids, at least about 288 amino acids, or at least about 864 amino acids. In some embodiments, the XTEN is selected from the group consisting of AE42, AG42, AE72, AG72, AE144, AG144, AE288, AG288, AE864, and AG864. Non-limiting examples of the XTENs that can be inserted in or fused to a FIX polypeptide are included elsewhere herein.

In some embodiments, an XTEN comprising 42 amino acids, e.g., AE42 or AG42, is inserted within the FIX polypeptide at an insertion site corresponding to an amino acid selected from the group consisting of amino acid 103 of SEQ ID NO: 1 or 2, amino acid 105 of SEQ ID NO: 1 or 2, amino acid 142 of SEQ ID NO: 1 or 2, amino acid 149 of SEQ ID NO: 1 or 2, amino acid 162 of SEQ ID NO: 1 or 2, amino acid 166 of SEQ ID NO: 1 or 2, amino acid 174 of SEQ ID NO: 1 or 2, amino acid 224 of SEQ ID NO: 1 or 2, amino acid 226 of SEQ ID NO: 1 or 2, amino acid 228 of SEQ ID NO: 1 or 2, amino acid 413 of SEQ ID NO: 1 or 2 and any combination thereof, wherein the FIX fusion protein exhibits procoagulant activity.

In some embodiments, an XTEN comprising 72 amino acids, e.g., AE72 or AG72, is inserted within the FIX polypeptide at an insertion site corresponding to an amino acid selected from the group consisting of amino acid 149 of SEQ ID NO: 1 or 2, amino acid 162 of SEQ ID NO: 1 or 2, amino acid 166 of SEQ ID NO: 1 or 2, amino acid 174 of SEQ ID NO: 1 or 2, amino acid 224 of SEQ ID NO: 1 or 2, amino acid 226 of SEQ ID NO: 1 or 2, amino acid 228 of SEQ ID NO: 1 or 2, amino acid 413 of SEQ ID NO: 1 or 2 and any combination thereof, or the XTEN is fused to the C-terminus, wherein the FIX fusion protein exhibits procoagulant activity.

In some embodiments, an XTEN comprising 144 amino acids, e.g., AE144 or AG144, is inserted within the FIX polypeptide at an insertion site corresponding to an amino acid selected from the group consisting of amino acid 149 of SEQ ID NO: 1 or 2, amino acid 162 of SEQ ID NO: 1 or 2, amino acid 166 of SEQ ID NO: 1 or 2, amino acid 174 of SEQ ID NO: 1 or 2, amino acid 224 of SEQ ID NO: 1 or 2, amino acid 226 of SEQ ID NO: 1 or 2, amino acid 228 of SEQ ID NO: 1 or 2, amino acid 413 of SEQ ID NO: 1 or 2 and any combination thereof, wherein the FIX fusion protein exhibits procoagulant activity.

In some embodiments, an XTEN comprising 288 amino acids, e.g., AE288 or AG288, is inserted within the FIX polypeptide at an insertion site corresponding to an amino acid selected from the group consisting of amino acid 149 of SEQ ID NO: 1 or 2, amino acid 162 of SEQ ID NO: 1 or 2, amino acid 166 of SEQ ID NO: 1 or 2, amino acid 174 of SEQ ID NO: 1 or 2, amino acid 224 of SEQ ID NO: 1 or 2, amino acid 226 of SEQ ID NO: 1 or 2, amino acid 228 of SEQ ID NO: 1 or 2, amino acid 413 of SEQ ID NO: 1 or 2 and any combination thereof, wherein the FIX fusion protein exhibits procoagulant activity.

In still other embodiments, an XTEN comprising 864 amino acids, e.g., AE864 or AG8648, is inserted within the FIX polypeptide at an insertion site corresponding to an amino acid selected from the group consisting of amino acid 149 of SEQ ID NO: 1 or 2, amino acid 162 of SEQ ID NO: 1 or 2, amino acid 166 of SEQ ID NO: 1 or 2, amino acid 174 of SEQ ID NO: 1 or 2, amino acid 224 of SEQ ID NO: 1 or 2, amino acid 224 of SEQ ID NO: 1 or 2, amino acid 226 of SEQ ID NO: 1 or 2, amino acid 228 of SEQ ID NO: 1 or 2, amino acid 413 of SEQ ID NO: 1 or 2 and any combination thereof, wherein the FIX fusion protein exhibits procoagulant activity.

The FIX fusion protein of the present invention can further comprise a second heterologous moiety, e.g., a second XTEN, inserted within the FIX, fused to the C-terminus of the FIX, or both. The second heterologous moiety can be inserted within the FIX polypeptide at an insertion site corresponding to an amino acid selected from the group consisting of amino acid 103 of SEQ ID NO: 1 or 2, amino acid 105 of SEQ ID NO: 1 or 2, amino acid 142 of SEQ ID NO: 1 or 2, amino acid 149 of SEQ ID NO: 1 or 2, amino acid 162 of SEQ ID NO: 1 or 2, amino acid 166 of SEQ ID NO: 1 or 2, amino acid 174 of SEQ ID NO: 1 or 2, amino acid 224 of SEQ ID NO: 1 or 2, amino acid 226 of SEQ ID NO: 1 or 2, amino acid 228 of SEQ ID NO: 1 or 2, amino acid 413 of SEQ ID NO: 1 or 2, and any combination thereof or wherein the second XTEN is fused to the C-terminus of the FIX polypeptide. In some embodiments, the first XTEN and the second XTEN are inserted within the FIX polypeptide at insertion sites corresponding to an amino acid of SEQ ID NO: 1 or 2 and/or fused to the C-terminus of the FIX polypeptide selected from the group consisting of amino acid 105 of SEQ ID NO: 1 or 2 and amino acid 166 of SEQ ID NO: 1 or 2; amino acid 105 of SEQ ID NO: 1 or 2 and amino acid 224 of SEQ ID NO: 1 or 2; amino acid 105 of SEQ ID NO: 1 or 2 and fused to the C-terminus; amino acid 166 of SEQ ID NO: 1 or 2 and amino acid 224 of SEQ ID NO: 1 or 2; amino acid 166 of SEQ ID NO: 1 or 2 and fused to the C-terminus; and amino acid 224 of SEQ ID NO: 1 or 2 and fused to the C-terminus, respectively. In one embodiment, the first XTEN is inserted within the FIX polypeptide at an insertion site corresponding to amino acid 166 of SEQ ID NO: 1 or 2, and the second XTEN is fused to the C-terminus of the FIX polypeptide.

The second XTEN can comprise at least about 6 amino acids, at least about 12 amino acids, at least about 36 amino acids, at least about 42 amino acids, at least about 72 amino acids, at least about 144 amino acids, or at least about 288 amino acids. In some embodiments, the second XTEN comprises 6 amino acids, 12 amino acids, 36 amino acids, 42 amino acids, 72 amino acids, 144 amino acids, or 288 amino acids. The second XTEN can be selected from the group consisting of AE42, AE72, AE864, AE576, AE288, AE144, AG864, AG576, AG288, AG144, and any combination thereof. In one particular embodiment, the second XTEN is AE72 or AE144.

In one particular embodiment, the second XTEN comprises an amino acid sequence at least about 80%, at least about 85%, at least about 90%, at least about 95%, at least about 96%, at least about 97%, at least about 98%, at least about 99%, or about 100% identical to an amino acid sequence selected from the group consisting of SEQ ID NOs: 34, 35, 36, 37, 38, 39, 40, 41, 42, 43, 44, 45, 46, 47, 48, 49, 50, 51, 52, 53, and any combination thereof.

In some embodiments, the FIX fusion protein further comprises a third, a fourth, a fifth, and/or a sixth XTEN.

In some embodiments, the FIX fusion protein comprises an amino acid sequence at least about 80%, at least about 85%, at least about 90%, at least about 95%, at least about 96%, at least about 97%, at least about 98%, at least about 99%, or about 100% identical to a sequence selected from the group consisting of SEQ ID NO: 54 to SEQ ID NO: 153 without the signal peptide and the propeptide sequence. In certain embodiments, the FIX fusion protein comprises an amino acid sequence selected from the group consisting of SEQ ID NO: 54 to SEQ ID NO: 153 without the signal peptide and the propeptide sequence. In one embodiment, the FIX fusion protein comprises an amino acid sequence at least about 80%, at least about 85%, at least about 90%, at least about 95%, at least about 96%, at least about 97%, at least about 98%, at least about 99%, or about 100% identical to a sequence selected from the group consisting of SEQ ID NOs: 119, 120, 121, and 123 without the signal peptide and the propeptide sequence. In another embodiment, the FIX fusion protein comprises an amino acid sequence selected from the group consisting of SEQ ID NOs: 119, 120, 123, 121 and 226 or 122 without the signal peptide and the propeptide sequence. In some embodiments, the FIX fusion protein is selected from group consisting of FIX-AP.72, FIX-AP.144, FIX-CT.72, FIX-CT.144, FIX-AP.288, and FIX-CT.288 without the signal peptide and the propeptide sequence.

In some embodiments, the FIX fusion protein comprises two different types of heterologous moieties. In some embodiments, the FIX fusion protein comprises a FIX polypeptide, an XTEN, and an Fc domain (or an FcRn binding partner) or a fragment thereof. In some embodiments, the XTEN is inserted within the FIX, and the Fc domain (or an FcRn binding partner) or a fragment thereof is fused to the C-terminus of the FIX. In some embodiments, the XTEN is inserted within the FIX polypeptide at one or more insertion sites selected from the insertion sites listed in table 3. In one embodiment, the XTEN is inserted within the FIX polypeptide at an insertion site corresponding to an amino acid selected from the group consisting of amino acid 103 of SEQ ID NO: 1 or 2, amino acid 105 of SEQ ID NO: 1 or 2, amino acid 142 of SEQ ID NO: 1 or 2, amino acid 149 of SEQ ID NO: 1 or 2, amino acid 162 of SEQ ID NO: 1 or 2, amino acid 166 of SEQ ID NO: 1 or 2, amino acid 174 of SEQ ID NO: 1 or 2, amino acid 224 of SEQ ID NO: 1 or 2, amino acid 226 of SEQ ID NO: 1 or 2, amino acid 228 of SEQ ID NO: 1 or 2, and amino acid 413 of SEQ ID NO: 1 or 2; and the Fc domain (or an FcRn binding partner) or a fragment thereof is fused to the C-terminus of the FIX. In certain embodiments, the XTEN is inserted within the FIX polypeptide at an insertion site corresponding to an amino acid selected from the group consisting of amino acid 105 of SEQ ID NO: 1 or 2, amino acid 166 of SEQ ID NO: 1 or 2, and amino acid 224 of SEQ ID NO: 1 or 2; and the Fc domain (or an FcRn binding partner) or a fragment thereof is fused to the C-terminus of the FIX. In some embodiments, the XTEN is selected from AE42, AE72, and AE144.

In certain aspects of the invention, the FIX fusion protein comprises one or two polypeptide chains. In one embodiment, the FIX fusion protein comprises two polypeptide chains, wherein the first polypeptide chain comprises the FIX polypeptide fused to an Fc domain (or an FcRn binding partner), and the second polypeptide chain comprises a second Fc domain, wherein the first Fc domain (or an FcRn binding partner) and the second Fc domain (or an FcRn binding partner) are associated by a covalent bond.

In another embodiment, the FIX fusion protein comprises a single polypeptide chain comprising a FIX polypeptide and an Fc domain (or an FcRn binding partner). In one particular embodiment, the FIX fusion protein further comprises a linker, which links the FIX polypeptide and the Fc domain (or an FcRn binding partner). In another embodiment, the FIX fusion protein comprises a FIX polypeptide, an Fc domain, and a second Fc domain (or an FcRn binding partner). In one particular embodiment, the FIX fusion protein further comprises a linker, which links the Fc domain (or an FcRn binding partner) and the second Fc domain (or an FcRn binding partner). In another embodiment, the FIX fusion protein comprises a FIX polypeptide, an Fc domain (or an FcRn binding partner), and a second Fc domain (or an FcRn binding partner), wherein the FIX polypeptide is linked to the Fc domain (or an FcRn binding partner) by a linker. In another embodiment, the FIX fusion protein comprises a FIX polypeptide, an Fc domain (or an FcRn binding partner), and a second Fc domain (or an FcRn binding partner), wherein the FIX polypeptide is linked to the Fc domain (or an FcRn binding partner) by a first linker, and wherein the Fc domain (or an FcRn binding partner) is linked to the second Fc domain (or an FcRn binding partner) by a linker. In certain embodiments, the FIX fusion protein comprises a formula selected from the group consisting of:

(i) FIX(X)-F1;
(ii) FIX(X)-L1-F1;
(iii) FIX(X)-F1-F2;
(iv) FIX(X)-L1-F1-F2;
(v) FIX(X)-L1-F1-L2-F2;
(vi) FIX(X)-F1-L1-F2;
(vii) FIX(X)-F1:F2;
(viii) FIX(X)-L1-F1:F2; and
(ix) any combination thereof, wherein FIX(X) is a FIX polypeptide having an XTEN inserted one or more insertion sites described herein; each of L1 and L2 is a linker; F1 is an Fc domain or an FcRn binding partner; F2 is a second Fc domain or a second FcRn binding partner, (-) is a peptide bond or one or more amino acids; and (:) is a covalent bond, e.g., a disulfide bond.

The linkers (L1 and L2) can be the same or different. The linker can be cleavable or non-cleavable, and the linker can comprise one or more intracellular processing sites. Non-limiting examples of the linkers are described elsewhere herein. Any of the linkers can be used to combine FIX with a heterologous moiety (e.g., XTEN or Fc) or a first heterologous moiety (e.g., first Fc) with a second heterologous moiety (e.g., second Fc)

In certain embodiments, the linker comprises a thrombin cleavage site. In one particular embodiment, the thrombin cleavage site comprises XVPR, wherein X is any aliphatic amino acid (e.g., glycine, alanine, valine, leucine, or isoleucine). In one particular embodiment, the thrombin cleave site comprises LVPR. In some embodiments, the linker comprises a PAR1 exosite interaction motif, which comprises SFLLRN (SEQ ID NO: 190). In some embodiments, the PAR1 exosite interaction motif further comprises an amino acid sequence selected from P, PN, PND, PNDK (SEQ ID NO: 191), PNDKY (SEQ ID NO: 192), PNDKYE (SEQ ID NO: 193), PNDKYEP (SEQ ID NO: 194), PNDKYEPF (SEQ ID NO: 195), PNDKYEPFW (SEQ ID NO: 196), PNDKYEPFWE (SEQ ID NO: 197), PNDKYEPFWED (SEQ ID NO: 198), PNDKYEPFWEDE (SEQ ID NO: 199), PNDKYEPFWEDEE (SEQ ID NO: 200), PNDKYEPFWEDEES (SEQ ID NO: 201), or any combination thereof. In other embodiments the linker comprises the FXIa cleavage site LDPR.

In one particular embodiment, the FIX fusion protein comprises a FIX polypeptide and a heterologous moiety, which comprises an XTEN, wherein the XTEN is fused with or without a linker, which linker may or may not be cleavable, to the C-terminus of the FIX polypeptide and comprises an amino acid sequence of longer than 42 amino acids and shorter than 864 amino acids in length, preferably shorter than 144 amino acids in length. The XTEN can comprise an amino acid sequence of longer than 42, 43, 44, 45, 46, 47, 48, 49, 50, 51, 52, 53, 54, 55, 56, 57, 58, 59, 60, 61, 62, 63, 64, 65, 66, 67, 68, 69, 70, or 71 amino acids and shorter than 140, 139, 138, 137, 136, 135, 134, 133, 132, 131, 130, 129, 128, 127, 126, 125, 124, 123, 122, 121, 120, 119, 118, 117, 116, 115, 114, 113, 112, 111, 110, 109, 108, 107, 106, 105, 104, 103, 102, 101, 100, 99, 98, 97, 96, 95, 94, 93, 92, 91, 90, 89, 88, 87, 86, 85, 84, 83, 82, 81, 80, 79, 78, 76, 75, 74, or 73 etc, amino acids or any combination thereof. In some embodiments, the XTEN 15 72 amino acids in length. In one particular embodiment, the XTEN is AE72. In another embodiment, the XTEN comprises an amino acid sequence at least about 80%, at least about 85%, at least about 90%, at least about 95%, at least about 96%, at least about 97%, at least about 98%, at least about 99%, or 100% identical to SEQ ID NO: 35.

In some embodiments, the FIX fusion protein comprises a FIX polypeptide that contains at least one inserted XTEN sequence and a heterologous moiety comprising an XTEN, wherein the XTEN is fused with or without a linker, which linker may or may not be cleavable, to the C-terminus of the FIX polypeptide. In some embodiments, the XTEN is shorter than 864 amino acids in length, preferably shorter than 144 amino acids in length. In other embodiments, the XTEN comprises an amino acid sequence of shorter than 244, 140, 130, 120, 110, 100, 90, 80, or 75 amino acids in length.

In other embodiments, the FIX fusion protein comprises a formula selected from the group consisting of:
 (i) FIX-X
 (ii) FIX-L1-X
 (iii) FIX(X)-X
 (iv) FIX(X)-L1-X
 (v) FIX(X)-L1: X
 (vi) any combination thereof,
wherein FIX is a FIX polypeptide; FIX(X) is a FIX polypeptide having at least one XTEN inserted into one or more insertion sites described herein; (X) is an XTEN which is longer than 42 amino acids and shorter than 144 amino acids; X is an XTEN which is longer than 42 amino acids and shorter than 864 amino acids such as 288 amino acids, preferably shorter than 144 amino acids (e.g., an XTEN with 72 amino acids); L1 is a linker; (-) is a peptide bond or one or more amino acids; and (:) is a covalent bond, e.g., a disulfide bond.

The linker (L1) can be the same or different. The linker can be cleavable or non-cleavable as needed, and the linker can comprise one or more intracellular processing sites. Non-limiting examples of the linkers are described elsewhere herein. Any of the linkers can be used to combine FIX with a heterologous moiety (e.g., XTEN or Fc).The following are non-limiting examples of linkers that are suitable for many invention embodiments:

a) GPEGPSKLTRAETGAGSPGAETAEQKLISEEDLSPATGHHHHHHHH (SEQ ID NO: 219, Thrombin);

b) GAGSPGAETALVPRGAGSPGAETAG (SEQ ID NO: 220,

Thrombin-PAR1);

c) GAGSPGAETALVPRSFLLRNPNDKYEPFWEDEESGAGSPGAETA (SEQ ID NO: 221);

d) GPEGPSKLTRAETGAGSPGAETA (SEQ ID NO: 222)

e) GGGGALRPRVVGGAGSPGAETA (SEQ ID NO: 223)

f) GGGGTLDPRSFLLRNPNDKYEPFWEDEEKGGAGSPGAETA (SEQ ID NO: 224)

g) GGAGSPGAETA (SEQ ID NO: 225)

In certain other embodiments, the linker comprises a thrombin cleavage site. In one particular embodiment, the thrombin cleavage site comprises XVPR, wherein X is any aliphatic amino acid (e.g., glycine, alanine, valine, leucine, or isoleucine). In one particular embodiment, the thrombin cleave site comprises LVPR.. In some embodiments, the linker comprises a PAR1 exosite interaction motif, which comprises SFLLRN (SEQ ID NO: 190). In some embodiments, the PAR1 exosite interaction motif further comprises an amino acid sequence selected from P, PN, PND, PNDK (SEQ ID NO: 191), PNDKY (SEQ ID NO: 192), PNDKYE (SEQ ID NO: 193), PNDKYEP (SEQ ID NO: 194), PNDKYEPF (SEQ ID NO: 195), PNDKYEPFW (SEQ ID NO: 196), PNDKYEPFWE (SEQ ID NO: 197), PNDKYEPFWED (SEQ ID NO: 198), PNDKYEPFWEDE (SEQ ID NO: 199), PNDKYEPFWEDEE (SEQ ID NO: 200), PNDKYEPFWEDEES (SEQ ID NO: 201), or any combination thereof. In certain other embodiment the linker comprises a FXIa cleavage site comprising LDPR, which can be combined with the PAR1 exosite interaction motif.

In certain embodiments, the FIX polypeptide fused to an XTEN at the C-terminus can further comprise a second XTEN. The second XTEN can be fused to or inserted in any part of the FIX fusion protein, including but not limited to the insertion sites disclosed herein. The FIX fusion protein can further comprise a third XTEN, a fourth XTEN, a fifth XTEN, or a sixth XTEN.

The FIX fusion protein of the present invention maintains a level of activity compared to native FIX. In some embodiments, the FIX fusion protein has at least about 10%, at least about 20%, at least about 30%, at least about 40%, at least about 50%, at least about 60%, at least about 70%, at least about 80%, at least about 90% or 100% of the procoagulant activity of native FIX. Procoagulant activity can be measured by any method known in the art, including but not limited to a chromogenic substrate assay, a one stage clotting assay, or both.

II.A. Factor IX

Human Factor IX (FIX) is a serine protease that is an important component of the intrinsic pathway of the blood coagulation cascade. "Factor IX" or "FIX," as used herein, refers to a coagulation factor protein and species and sequence variants thereof, and includes, but is not limited to, the 461 single-chain amino acid sequence of human FIX precursor polypeptide ("prepro"), the 415 single-chain amino acid sequence of mature human FIX (SEQ ID NO: 1), and the R338L FIX (Padua) variant (SEQ ID NO: 2). FIX includes any form of FIX molecule with the typical characteristics of blood coagulation FIX. As used herein "Factor IX" and "FIX" are intended to encompass polypeptides that comprise the domains Gla (region containing y-carboxyglutamic acid residues), EGF1 and EGF2 (regions containing sequences homologous to human epidermal growth factor), activation peptide ("AP," formed by residues R136-R180 of the mature FIX), and the C-terminal protease domain ("Pro"), or synonyms of these domains known in the art, or can be a truncated fragment or a sequence variant that retains at least a portion of the biological activity of the native protein. FIX or sequence variants have been cloned, as described in U.S. Pat. Nos. 4,770,999 and 7,700,734, and cDNA coding for human Factor IX has been isolated, characterized, and cloned into expression vectors (see, for example, Choo et al., Nature 299:178-180 (1982); Fair et al., Blood 64:194-204 (1984); and Kurachi et al., Proc. Natl. Acad. Sci., U.S.A. 79:6461-6464 (1982)). One particular variant of FIX, the R338L FIX (Padua) variant (SEQ ID NO: 2), characterized by Simioni et al, 2009, comprises a gain-of-function mutation, which correlates with a nearly 8-fold increase in the activity of the Padua variant relative to native FIX (Table 1). FIX variants can also include any FIX polypeptide having one or more conservative amino acid substitutions, which do not affect the FIX activity of the FIX polypeptide.

IX of 415 amino acids (SEQ ID NO: 1 or 2). The propeptide is an 18-amino acid residue sequence N-terminal to the gamma-carboxyglutamate domain. The propeptide binds vitamin K-dependent gamma carboxylase and then is cleaved from the precursor polypeptide of FIX by an endogenous protease, most likely PACE (paired basic amino acid cleaving enzyme), also known as furin or PCSK3. Without the gamma carboxylation, the Gla domain is unable to bind calcium to assume the correct conformation necessary to anchor the protein to negatively charged phospholipid surfaces, thereby rendering Factor IX nonfunctional. Even if it is carboxylated, the Gla domain also depends on cleavage of the propeptide for proper function, since retained propeptide interferes with conformational changes of the Gla domain necessary for optimal binding to calcium and phospholipid. In humans, the resulting mature Factor IX is secreted by liver cells into the blood stream as an inactive zymogen, a single chain protein of 415 amino acid residues that contains approximately 17% carbohydrate by weight (Schmidt, A. E., et al. (2003) Trends Cardiovasc Med, 13: 39).

The mature FIX is composed of several domains that in an N- to C-terminus configuration are: a GLA domain, an EGF1 domain, an EGF2 domain, an activation peptide (AP) domain, and a protease (or catalytic) domain. A short linker connects the EGF2 domain with the AP domain. FIX contains two activation peptides formed by R145-A146 and R180-V181, respectively. Following activation, the single-chain FIX becomes a 2-chain molecule, in which the two chains are linked by a disulfide bond. Clotting factors can be engineered by replacing their activation peptides resulting in altered activation specificity. In mammals, mature FIX must be activated by activated Factor XI to yield Factor IXa. The protease domain provides, upon activation of FIX to FIXa, the catalytic activity of FIX. Activated Factor VIII (FVIIIa) is the specific cofactor for the full expression of FIXa activity.

TABLE 1

Example FIX Sequences

SEQ ID NO: 1 (mature FIX polypeptide)

```
  1: YNSGKLEEFV QGNLERECME EKCSFEEARE VFENTERTTE FWKQYVDGDQ CESNPCLNGG
 61: SCKDDINSYE CWCPFGFEGK NCELDVTCNI KNGRCEQFCK NSADNKVVCS CTEGYRLAEN
121: QKSCEPAVPF PCGRVSVSQT SKLTRAETVF PDVDYVNSTE AETILDNITQ STQSFNDFTR
181: VVGGEDAKPG QFPWQVVLNG KVDAFCGGSI VNEKWIVTAA HCVETGVKIT VVAGEHNIEE
241: TEHTEQKRNV IRIIPHHNYN AAINKYNHDI ALLELDEPLV LNSYVTPICI ADKEYTNIFL
301: KFGSGYVSGW GRVFHKGRSA LVLQYLRVPL VDRATCLRST KFTIYNNMFC AGFHEGGRDS
361: CQGDSGGPHV TEVEGTSFLT GIISWGEECA MKGKYGIYTK VSRYVNWIKE KTKLT
```

SEQ ID NO: 2 (mature Padua(R338L)FIX Polypeptide)

```
  1: YNSGKLEEFV QGNLERECME EKCSFEEARE VFENTERTTE FWKQYVDGDQ CESNPCLNGG
 61: SCKDDINSYE CWCPFGFEGK NCELDVTCNI KNGRCEQFCK NSADNKVVCS CTEGYRLAEN
121: QKSCEPAVPF PCGRVSVSQT SKLTRAETVF PDVDYVNSTE AETILDNITQ STQSFNDFTR
181: VVGGEDAKPG QFPWQVVLNG KVDAFCGGSI VNEKWIVTAA HCVETGVKIT VVAGEHNIEE
241: TEHTEQKRNV IRIIPHHNYN AAINKYNHDI ALLELDEPLV LNSYVTPICI ADKEYTNIFL
301: KFGSGYVSGW GRVFHKGRSA LVLQYLRVPL VDRATCLLST KFTIYNNMFC AGFHEGGRDS
361: CQGDSGGPHV TEVEGTSFLT GIISWGEECA MKGKYGIYTK VSRYVNWIKE KTKLT
```

SEQ ID NO: 3 (FIX Signal Polypeptide and Propeptide)

```
  1: MQRVNMIMAE SPGLITICLL GYLLSAECTV FLDREVANKI LNRPKR
```

The FIX polypeptide is 55 kDa, synthesized as a prepropolypeptide chain (SEQ ID NO: 1) composed of three regions: a signal peptide of 28 amino acids (amino acids 1 to 28 of SEQ ID NO: 3), a propeptide of 18 amino acids (amino acids 29 to 46), which is required for gamma-carboxylation of glutamic acid residues, and a mature Factor In other embodiments, a FIX polypeptide comprises an Thr148 allelic form of plasma derived Factor IX and has structural and functional characteristics similar to endogenous Factor IX.

A great many functional FIX variants are known. International publication number WO 02/040544 A3 discloses mutants that exhibit increased resistance to inhibition by heparin at page 4, lines 9-30 and page 15, lines 6-31. International publication number WO 03/020764 A2 discloses FIX mutants with reduced T cell immunogenicity in Tables 2 and 3 (on pages 14-24), and at page 12, lines 1-27. International publication number WO 2007/149406 A2 discloses functional mutant FIX molecules that exhibit increased protein stability, increased in vivo and in vitro half-life, and increased resistance to proteases at page 4, line 1 to page 19, line 11. WO 2007/149406 A2 also discloses chimeric and other variant FIX molecules at page 19, line 12 to page 20, line 9. International publication number WO 08/118507 A2 discloses FIX mutants that exhibit increased clotting activity at page 5, line 14 to page 6, line 5. International publication number WO 09/051717 A2 discloses FIX mutants having an increased number of N-linked and/or O-linked glycosylation sites, which results in an increased half-life and/or recovery at page 9, line 11 to page 20, line 2. International publication number WO 09/137254 A2 also discloses Factor IX mutants with increased numbers of glycosylation sites at page 2, paragraph [006] to page 5, paragraph [011] and page 16, paragraph [044] to page 24, paragraph [057]. International publication number WO 09/130198 A2 discloses functional mutant FIX molecules that have an increased number of glycosylation sites, which result in an increased half-life, at page 4, line 26 to page 12, line 6. International publication number WO 09/140015 A2 discloses functional FIX mutants that an increased number of Cys residues, which can be used for polymer (e.g., PEG) conjugation, at page 11, paragraph [0043] to page 13, paragraph [0053]. The FIX polypeptides described in International Application No. PCT/US2011/043569 filed Jul. 11, 2011 and published as WO 2012/006624 on Jan. 12, 2012 are also incorporated herein by reference in its entirety.

In addition, hundreds of non-functional mutations in FIX have been identified in hemophilia subjects, many of which are disclosed in Table 5, at pages 11-14 of International publication number WO 09/137254 A2. Such non-functional mutations are not included in the invention, but provide additional guidance for which mutations are more or less likely to result in a functional FIX polypeptide.

In one embodiment, the FIX polypeptide (or Factor IX portion of a fusion polypeptide) comprises an amino acid sequence at least 70%, at least 80%, at least 85%, at least 90%, at least 95%, at least 96%, at least 97%, at least 98%, at least 99%, or 100% identical to the sequence set forth in SEQ ID NO: 1 or 2 (amino acids 1 to 415 of SEQ ID NO: 1 or 2), or alternatively, with a propeptide sequence, or with a propeptide and signal sequence (full length FIX). In another embodiment, the FIX polypeptide comprises an amino acid sequence at least 70%, at least 80%, at least 85%, at least 90%, at least 95%, at least 96%, at least 97%, at least 98%, at least 99%, or 100% identical to the sequence set forth in SEQ ID NO: 2.

Factor IX coagulant activity is expressed as International Unit(s) (IU). One IU of FIX activity corresponds approximately to the quantity of FIX in one milliliter of normal human plasma. Several assays are available for measuring Factor IX activity, including the one stage clotting assay (activated partial thromboplastin time; aPTT), thrombin generation time (TGA) and rotational thromboelastometry (ROTEM®). The invention contemplates sequences that have homology to FIX sequences, sequence fragments that are natural, such as from humans, non-human primates, mammals (including domestic animals), and non-natural sequence variants which retain at least a portion of the biologic activity or biological function of FIX and/or that are useful for preventing, treating, mediating, or ameliorating a coagulation factor-related disease, deficiency, disorder or condition (e.g., bleeding episodes related to trauma, surgery, of deficiency of a coagulation factor). Sequences with homology to human FIX can be found by standard homology searching techniques, such as NCBI BLAST.

II.B. Heterologous Moieties

An FIX fusion protein of the invention can comprise at least one heterologous moiety inserted into one or more sites within the FIX polypeptide, fused to the C-terminus, or both, wherein the FIX fusion protein has procoagulant activity and can be expressed in vivo or in vitro in a host cell. A "heterologous moiety" can comprise a heterologous polypeptide, or a non-polypeptide moiety, or both. In certain aspects, the heterologous moiety is an XTEN. In some aspects, a FIX fusion protein of the invention comprises at least one XTEN inserted into one or more sites within the FIX polypeptide. In other aspects, a FIX fusion protein comprises at least one heterologous moiety inserted into one or more sites within the FIX polypeptide, wherein the heterologous moiety is a half-life extending moiety (e.g., an in vivo half-life extending moiety).

It is believed that the discovery of the insertions sites wherein the FIX retains at least some of its procoagulant activity would also permit the insertion of other peptides and polypeptides with either unstructured or structured characteristics that are associated with the prolongation of half-life when fused to a FIX protein in one or more of those same sites. Non-limiting examples of heterologous moieties (e.g., a half-life extending moiety) include albumin, albumin fragments, Fc fragments of immunoglobulins, FcRn binding partners, the C-terminal peptide (CTP) of the 13 subunit of human chorionic gonadotropin, a HAP sequence, a transferrin, the PAS polypeptides of U.S. Pat Application No. 20100292130, polyglycine linkers, polyserine linkers, peptides and short polypeptides of 6-40 amino acids of two types of amino acids selected from glycine (G), alanine (A), serine (S), threonine (T), glutamate (E) and proline (P) with varying degrees of secondary structure from less than 50% to greater than 50%, amongst others, would be suitable for insertion in the identified active insertions sites of FIX.

In certain aspects a heterologous moiety increases the in vivo or in vitro half-life of the FIX fusion protein. In other aspects a heterologous moiety facilitates visualization or localization of the FIX fusion protein. Visualization and/or location of the FIX fusion protein can be in vivo, in vitro, ex vivo, or combinations thereof. In other aspects a heterologous moiety increases stability of the FIX fusion protein. As used herein, the term "stability" refers to an art-recognized measure of the maintenance of one or more physical properties of the FIX fusion protein in response to an environmental condition (e.g., an elevated or lowered temperature). In certain aspects, the physical property is the maintenance of the covalent structure of the FIX fusion protein (e.g., the absence of proteolytic cleavage, unwanted oxidation or deamidation). In other aspects, the physical property can also be the presence of the FIX fusion protein in a properly folded state (e.g., the absence of soluble or insoluble aggregates or precipitates). In one aspect, the stability of the FIX fusion protein is measured by assaying a biophysical property of the FIX fusion protein, for example thermal stability, pH unfolding profile, stable removal of glycans, solubility, biochemical function (e.g., ability to bind to another protein), etc., and/or combinations thereof. In another aspect, biochemical function is demonstrated by the binding affinity of the interaction. In one aspect, a measure of protein stability is thermal stability, i.e., resistance to thermal challenge. Stability can be measured using methods known in the art, such as, HPLC (high performance liquid chromatography), SEC (size exclusion chromatography), DLS (dynamic light scattering), etc. Methods to measure thermal stability include, but are not limited to differential scanning calorimetry (DSC), differential scanning fluorometry (DSF), circular dichroism (CD), and thermal challenge assay.

In a specific aspect, a heterologous moiety inserted in one or more insertion cites in a FIX fusion protein retains the biochemical activity of the FIX fusion protein. In certain embodiments, the heterologous moiety is an XTEN. In one embodiment, the biochemical activity is FIX activity, which can be measured by chromogenic assay.

In some embodiments, at least one heterologous moiety is inserted indirectly in an insertion site via linkers located at the N-terminus, the C-terminus, or both the N-terminus and C-terminus of the heterologous moiety. The linkers at the N-terminus and C-terminus of the heterologous moiety can be the same or different. In some embodiments, several linkers can flank one or both termini of the heterologous moiety in tandem. In some embodiments, the linker is "Gly-Ser peptide linker." The term "Gly-Ser peptide linker" refers to a peptide that comprises glycine and serine residues.

An exemplary Gly/Ser peptide linker includes, but is not limited to, the amino acid sequence $(Gly_4Ser)_n$ (SEQ ID NO:161), wherein n is an integer that is the same or higher than 1, 2, 3, 4, 5, 6, 7, 8, 9, 10, 15, 20, 25, 30, 35, 40, 46, 50, 55, 60, 70, 80, 90, or 100. In one embodiment, n=1, i.e., the linker is ($Gly_4Ser$) (SEQ ID NO: 161). In one embodiment, n=2, i.e., the linker is $(Gly_4Ser)_2$ (SEQ ID NO: 162). In another embodiment, n=3, i.e., the linker is $(Gly_4Ser)_3$ (SEQ ID NO: 172). In another embodiment, n=4, i.e., the linker is $(Gly_4Ser)_4$ (SEQ ID NO: 173). In another embodiment, n=5, i.e., the linker is $(Gly_4Ser)_5$ (SEQ ID NO: 174). In yet another embodiment, n=6, i.e., the linker is $(Gly_4Ser)_6$ (SEQ ID NO: 175). In another embodiment, n=7, i.e., the linker is $(Gly_4Ser)_7$ (SEQ ID NO: 176). In yet another embodiment, n=8, i.e., the linker is $(Gly_4Ser)_8$ (SEQ ID NO: 177). In another embodiment, n=9, i.e., the linker is $(Gly_4Ser)_9$ (SEQ ID NO: 178). In yet another embodiment, n=10, i.e., the linker is $(Gly_4Ser)_{10}$ (SEQ ID NO: 179).

Another exemplary Gly/Ser peptide linker comprises the amino acid sequence $Ser(Gly_4Ser)_n$ (SEQ ID NO: 180), wherein n is an integer that is the same or higher than 1, 2, 3, 4, 5, 6, 7, 8, 9, 10, 15, 20, 25, 30, 35, 40, 46, 50, 55, 60, 70, 80, 90, or 100. In one embodiment, n=1, i.e., the linker is $Ser(Gly_4Ser)$ (SEQ ID NO: 180). In one embodiment, n=2, i.e., the linker is $Ser(Gly_4Ser)_2$ (SEQ ID NO: 181). In another embodiment, n=3, i.e., the linker is $Ser(Gly_4Ser)_3$ (SEQ ID NO: 182). In another embodiment, n=4, i.e., the linker is $Ser(Gly_4Ser)_4$ (SEQ ID NO: 183). In another embodiment, n=5, i.e., the linker is $Ser(Gly_4Ser)_5$ (SEQ ID NO: 184). In yet another embodiment, n=6, i.e., the linker is $Ser(Gly_4Ser)_6$ (SEQ ID NO: 185). In yet another embodiment, n=7, i.e., the linker is $Ser(Gly_4Ser)_7$ (SEQ ID NO: 186). In yet another embodiment, n=8, i.e., the linker is $Ser(Gly_4Ser)_8$ (SEQ ID NO: 187). In yet another embodiment, n=9, i.e., the linker is $Ser(Gly_4Ser)_9$ (SEQ ID NO: 188). In yet another embodiment, n=10, i.e., the linker is $Ser(Gly_4Ser)_{10}$ (SEQ ID NO: 189).

In certain aspects, a FIX fusion protein comprises one heterologous moiety inserted at an insertion site listed in TABLE 7. In other aspects, a FIX fusion protein comprises two heterologous moieties inserted in two insertion sites listed in TABLE 7. In a particular embodiment, the two heterologous moieties are inserted in two insertion sites listed in TABLE 8. In certain aspects, a FIX fusion protein comprises three heterologous moieties inserted in three insertion sites listed in TABLE 7. In certain aspects, a FIX fusion protein comprises four heterologous moieties inserted in four insertion sites listed in TABLE 7. In certain aspects, a FIX fusion protein comprises five heterologous moieties inserted in five insertion sites listed in TABLE 7. In certain aspects, a FIX fusion protein comprises six heterologous moieties inserted in six insertion sites listed in TABLE 7. In some aspects, all the inserted heterologous moieties are identical. In other aspects, at least one of the inserted heterologous moieties is different from the rest of inserted heterologous moieties.

Fusion of the FIX polypeptide to the at least one heterologous moiety, e.g., XTEN, can affect the physical or chemical properties, e.g., pharmacokinetics, of the fusion protein of the present invention. In a specific embodiment, the heterologous moiety linked to a FIX protein increases at least one pharmacokinetic property, e.g., increased terminal half-life or increased area under the curve (AUC), so that the fusion protein described herein stays in vivo for an increased period of time compared to wild type FIX or a corresponding FIX lacking the heterologous moiety. In further embodiments, the XTEN sequence used in this invention increases at least one pharmacokinetic property, e.g., increased terminal half-life, increased recovery and/or increased bioavailability for subcutaneous dosing, increased area under the curve (AUC), so that FIX protein stays in vivo for an increased period of time compared to wild type FIX or a corresponding FIX lacking the heterologous moiety.

In certain aspects, a heterologous moiety which increases half-life of the FIX fusion protein of the invention comprises, without limitation, a heterologous polypeptide such as albumin, an immunoglobulin Fc region, an XTEN sequence, the C-terminal peptide (CTP) of the 13 subunit of human chorionic gonadotropin, a PAS sequence, a HAP sequence, a transferrin, albumin-binding moieties, or any fragments, derivatives, variants, or combinations of these polypeptides. In certain aspects the FIX fusion protein of the invention comprises a heterologous polypeptide which increases half-life, wherein the heterologous polypeptide is an XTEN sequence. In other related aspects a heterologous moiety can include an attachment site for a non-polypeptide moiety such as polyethylene glycol (PEG), hydroxyethyl starch (HES), polysialic acid, or any derivatives, variants, or combinations of these moieties.

In other embodiments, a FIX fusion protein of the invention is conjugated to one or more polymers. The polymer can be water-soluble or non-water-soluble. The polymer can be covalently or non-covalently attached to FIX or to other moieties conjugated to FIX. Non-limiting examples of the polymer can be poly(alkylene oxide), poly(vinyl pyrrolidone), poly(vinyl alcohol), polyoxazoline, or poly(acryloylmorpholine).

In certain aspects, a FIX fusion protein of the invention comprises one, two, three or more heterologous moieties, which can each be the same or different molecules. In some embodiments, the FIX fusion protein comprises one or more XTENs. In other embodiments, the FIX fusion protein comprises one or more XTENs and one or more Fc domains. In one particular embodiment, the FIX fusion protein can comprise an XTEN inserted within the FIX and an Fc fused to the C-terminus of the FIX.

The FIX fusion proteins of the present invention can have an increased in vivo half-life as compared to native FIX, rFIXFc, or FIX R338L. In some embodiments, the FIX fusion protein can have at least about 1.5 fold, at least about 2-fold, at least about 3-fold, or at least about 4-fold greater in vivo half-life as compared to native FIX lacking the heterologous moiety or as compared to FIX R338L lacking the heterologous moiety. In one particular embodiment, the FIX fusion protein has an in vivo half-life more than 2-fold greater than the FIX polypeptide without the heterologous moiety.

In other embodiments, the FIX fusion protein can have an in vivo half-life that is at least about 5 hours, at least about 6 hours, at least about 7 hours, at east about 8 hours, at least about 9 hours, at least about 10 hours, at east about 11 hours, at least about 12 hours, at least about 13 hours, at east about 14 hours, at least about 15 hours, at least about 16 hours, at east about 17 hours, at least about 18 hours, at least about 19 hours, at east about 20 hours, at least about 21 hours, at least about 22 hours, at east about 23 hours, at least about 24 hours, at least about 25 hours, at least about 26 hours, at least about 27 hours, at least about 28 hours, at east about 29 hours, at least about 30 hours, at least about 31 hours, at east about 32 hours, at least about 33 hours, or at least about 34 hours longer than the in vivo half-life of a FIX polypeptide lacking a heterologous moiety.

II.B.1. XTENs

In some embodiments, the at least one heterologous moiety is an XTEN. As used here "XTEN sequence" refers to extended length polypeptides with non-naturally occurring, substantially non-repetitive sequences that are composed mainly of small hydrophilic amino acids, with the sequence having a low degree or no secondary or tertiary structure under physiologic conditions. As a fusion protein partner, XTENs can serve as a carrier, conferring certain desirable pharmacokinetic, physicochemical and pharmaceutical properties when linked to a FIX sequence of the invention to create a fusion protein. Such desirable properties include but are not limited to enhanced pharmacokinetic parameters and solubility characteristics. As used herein, "XTEN" specifically excludes antibodies or antibody fragments such as single-chain antibodies or Fc fragments of a light chain or a heavy chain.

In certain aspects, a FIX fusion protein of the invention comprises at least one XTEN or fragment, variant, or derivative thereof inserted into the FIX, wherein the FIX fusion protein has procoagulant activity and can be expressed in vivo or in vitro in a host cell. In certain aspects, two of the heterologous moieties are XTEN sequences. In some aspects, three of the heterologous moieties are XTEN sequences. In some aspects, four of the heterologous moieties are XTEN sequences. In some aspects, five of the heterologous moieties are XTEN sequences. In some aspects, six or more of the heterologous moieties are XTEN sequences.

In some embodiments, the XTEN sequence useful for the invention is a peptide or a polypeptide having greater than about 20, 30, 40, 50, 60, 70, 80, 90, 100, 150, 200, 250, 300, 350, 400, 450, 500, 550, 600, 650, 700, 750, 800, 850, 900, 950, 1000, 1200, 1400, 1600, 1800, or 2000 amino acid residues. In certain embodiments, XTEN is a peptide or a polypeptide having greater than about 20 to about 3000 amino acid residues, greater than 30 to about 2500 residues, greater than 40 to about 2000 residues, greater than 50 to about 1500 residues, greater than 60 to about 1000 residues, greater than 70 to about 900 residues, greater than 80 to about 800 residues, greater than 90 to about 700 residues, greater than 100 to about 600 residues, greater than 110 to about 500 residues, or greater than 120 to about 400 residues. In one particular embodiment, the XTEN comprises an amino acid sequence of longer than 42 amino acids and shorter than 144 amino acids in length.

The XTEN sequence of the invention can comprise one or more sequence motif of 5 to 14 (e.g., 9 to 14) amino acid residues or an amino acid sequence at least 80%, 90%, 91%, 92%, 93%, 94%, 95%, 96%, 97%, 98%, or 99% identical to the sequence motif, wherein the motif comprises, consists essentially of, or consists of 4 to 6 types of amino acids (e.g., 5 amino acids) selected from the group consisting of glycine (G), alanine (A), serine (S), threonine (T), glutamate (E) and proline (P). See US 2010-0239554 A1.

In some embodiments, the XTEN comprises non-overlapping sequence motifs in which about 80%, or at least about 85%, or at least about 90%, or about 91%, or about 92%, or about 93%, or about 94%, or about 95%, or about 96%, or about 97%, or about 98%, or about 99% or about 100% of the sequence consists of multiple units of non-overlapping sequences selected from a single motif family selected from Table 2A, resulting in a family sequence. As used herein, "family" means that the XTEN has motifs selected only from a single motif category from Table 2A; i.e., AD, AE, AF, AG, AM, AQ, BC, or BD XTEN, and that any other amino acids in the XTEN not from a family motif are selected to achieve a needed property, such as to permit incorporation of a restriction site by the encoding nucleotides, incorporation of a cleavage sequence, or to achieve a better linkage to FIX. In some embodiments of XTEN families, an XTEN sequence comprises multiple units of non-overlapping sequence motifs of the AD motif family, or of the AE motif family, or of the AF motif family, or of the AG motif family, or of the AM motif family, or of the AQ motif family, or of the BC family, or of the BD family, with the resulting XTEN exhibiting the range of homology described above. In other embodiments, the XTEN comprises multiple units of motif sequences from two or more of the motif families of Table 2A. These sequences can be selected to achieve desired physical/chemical characteristics, including such properties as net charge, hydrophilicity, lack of secondary structure, or lack of repetitiveness that are conferred by the amino acid composition of the motifs, described more fully below. In the embodiments hereinabove described in this paragraph, the motifs incorporated into the XTEN can be selected and assembled using the methods described herein to achieve an XTEN of about 36 to about 3000 amino acid residues.

TABLE 2A

XTEN Sequence Motifs of 12 Amino Acids and Motif Families

| Motif Family* | MOTIF SEQUENCE | SEQ ID NO: |
|---|---|---|
| AD | GESPGGSSGSES | 4 |
| AD | GSEGSSGPGESS | 5 |
| AD | GSSESGSSEGGP | 6 |
| AD | GSGGEPSESGSS | 7 |
| AE, AM | GSPAGSPTSTEE | 8 |
| AE, AM, AQ | GSEPATSGSETP | 9 |
| AE, AM, AQ | GTSESATPESGP | 10 |
| AE, AM, AQ | GTSTEPSEGSAP | 11 |

TABLE 2A-continued

XTEN Sequence Motifs of 12 Amino Acids and Motif Families

| Motif Family* | MOTIF SEQUENCE | SEQ ID NO: |
|---|---|---|
| AF, AM | GSTSESPSGTAP | 12 |
| AF, AM | GTSTPESGSASP | 13 |
| AF, AM | GTSPSGESSTAP | 14 |
| AF, AM | GSTSSTAESPGP | 15 |
| AG, AM | GTPGSGTASSSP | 16 |
| AG, AM | GSSTPSGATGSP | 17 |
| AG, AM | GSSPSASTGTGP | 18 |
| AG, AM | GASPGTSSTGSP | 19 |
| AQ | GEPAGSPTSTSE | 20 |
| AQ | GTGEPSSTPASE | 21 |
| AQ | GSGPSTESAPTE | 22 |
| AQ | GSETPSGPSETA | 23 |
| AQ | GPSETSTSEPGA | 24 |
| AQ | GSPSEPTEGTSA | 25 |
| BC | GSGASEPTSTEP | 26 |
| BC | GSEPATSGTEPS | 27 |
| BC | GTSEPSTSEPGA | 28 |
| BC | GTSTEPSEPGSA | 29 |
| BD | GSTAGSETSTEA | 30 |
| BD | GSETATSGSETA | 31 |
| BD | GTSESATSESGA | 32 |
| BD | GTSTEASEGSAS | 33 |

*Denotes individual motif sequences that, when used together in various permutations, results in a "family sequence"

XTEN can have varying lengths for insertion into or linkage to FIX. In one embodiment, the length of the XTEN sequence(s) is chosen based on the property or function to be achieved in the fusion protein. Depending on the intended property or function, XTEN can be short or intermediate length sequence or longer sequence that can serve as carriers. In certain embodiments, the XTEN includes short segments of about 6 to about 99 amino acid residues, intermediate lengths of about 100 to about 399 amino acid residues, and longer lengths of about 400 to about 1000 and up to about 3000 amino acid residues. Thus, the XTEN inserted into or linked to FIX can have lengths of about 6, about 12, about 36, about 40, about 42, about 72, about 96, about 144, about 288, about 400, about 500, about 576, about 600, about 700, about 800, about 864, about 900, about 1000, about 1500, about 2000, about 2500, or up to about 3000 amino acid residues in length. In other embodiments, the XTEN sequences is about 6 to about 50, about 50 to about 100, about 100 to 150, about 150 to 250, about 250 to 400, about 400 to about 500, about 500 to about 900, about 900 to 1500, about 1500 to 2000, or about 2000 to about 3000 amino acid residues in length. The precise length of an XTEN inserted into or linked to FIX can vary without adversely affecting the activity of the FIX. In one embodiment, one or more of the XTENs used herein have 42 amino acids, 72 amino acids, 144 amino acids, 288 amino acids, 576 amino acids, or 864 amino acids in length and can be selected from one or more of the XTEN family sequences; i.e., AD, AE, AF, AG, AM, AQ, BC or BD.

In some embodiments, the XTEN sequence used in the invention is at least 60%, 70%, 80%, 85%, 90%, 91%, 92%, 93%, 94%, 95%, 96%, 97%, 98%, 99%, or 100% identical to a sequence selected from the group consisting of AE42, AG42, AE48, AM48, AE72, AG72, AE108, AG108, AE144, AF144, AG144, AE180, AG180, AE216, AG216, AE252, AG252, AE288, AG288, AE324, AG324, AE360, AG360, AE396, AG396, AE432, AG432, AE468, AG468, AE504, AG504, AF504, AE540, AG540, AF540, AD576, AE576, AF576, AG576, AE612, AG612, AE624, AE648, AG648, AG684, AE720, AG720, AE756, AG756, AE792, AG792, AE828, AG828, AD836, AE864, AF864, AG864, AM875, AE912, AM923, AM1318, BC864, BD864, AE948, AE1044, AE1140, AE1236, AE1332, AE1428, AE1524, AE1620, AE1716, AE1812, AE1908, AE2004A, AG948, AG1044, AG1140, AG1236, AG1332, AG1428, AG1524, AG1620, AG1716, AG1812, AG1908, AG2004, and any combination thereof. See US 2010-0239554 A1. In one particular embodiment, the XTEN comprises AE42, AE72, AE144, AE288, AE576, AE864, AG 42, AG72, AG144, AG288, AG576, AG864, or any combination thereof.

In one embodiment, the XTEN sequence is at least 60%, 70%, 80%, 90%, 95%, 96%, 97%, 98%, 99% or 100% identical to an amino acid sequence selected from the group consisting of AE36 (SEQ ID NO: 217), AE42 (SEQ ID NO: 34), AE72 (SEQ ID NO: 35), AE78 (SEQ ID NO: 218), AE144 (SEQ ID NO: 36), AE144_2A (SEQ ID NO: 37), AE144_3B (SEQ ID NO: 38), AE144_4A (SEQ ID NO: 39), AE144_5A (SEQ ID NO: 40), AE144_6B (SEQ ID NO: 41), AG144 (SEQ ID NO: 42), AG144_A (SEQ ID NO: 43), AG144_B (SEQ ID NO: 44), AG144_C (SEQ ID NO: 45), AG144_F (SEQ ID NO: 46), AE288 (SEQ ID NO: 47), AE288_2 (SEQ ID NO: 48), AG288 (SEQ ID NO: 49), AE576 (SEQ ID NO: 50), AG576 (SEQ ID NO: 51), AE864 (SEQ ID NO: 52), AG864 (SEQ ID NO: 53), XTEN_AE72_2A_1 (SEQ ID NO:202), XTEN_AE72_2A_2 (SEQ ID NO:203), XTEN_AE72_3B_1 (SEQ ID NO:204), XTEN_AE72_3B_2 (SEQ ID NO:205), XTEN_AE72_4A_2 (SEQ ID NO: 206), XTEN_AE72_5A_2 (SEQ ID NO:207), XTEN_AE72_6B_1 (SEQ ID NO: 208), XTEN_AE72_6B_2 (SEQ ID NO:209), XTEN_AE72_1A_1 (SEQ ID NO: 210), XTEN_AE72_1A_2 (SEQ ID NO:211), XTEN_AE144_1A (SEQ ID NO:212), AE150 (SEQ ID NO:213), AG150 (SEQ ID NO:214), AE294 (SEQ ID NO:215), AG294 (SEQ ID NO:216), and any combination thereof.

In some embodiments, less than 100% of amino acids of an XTEN are selected from glycine (G), alanine (A), serine (S), threonine (T), glutamate (E) and proline (P), or less than 100% of the sequence consists of the sequence motifs from Table 2A or the XTEN sequences of Table 2B. In such embodiments, the remaining amino acid residues of the XTEN are selected from any of the other 14 natural L-amino acids, but can be preferentially selected from hydrophilic amino acids such that the XTEN sequence contains at least about 90%, 91%, 92%, 93%, 94%, 95%, 96%, 97%, 98%, or at least about 99% hydrophilic amino acids. The content of hydrophobic amino acids in the XTEN utilized in the conjugation constructs can be less than 5%, or less than 2%, or less than 1% hydrophobic amino acid content. Hydrophobic residues that are less favored in construction of XTEN include tryptophan, phenylalanine, tyrosine, leucine, isoleucine, valine, and methionine. Additionally, XTEN sequences can contain less than 5% or less than 4% or less than 3% or less than 2% or less than 1% or none of the following amino acids: methionine (for example, to avoid oxidation), or asparagine and glutamine (to avoid desamidation).

In another embodiment, the XTEN sequence is selected from the group consisting of AE36 (SEQ ID NO: 217), AE42 (SEQ ID NO: 34), AE72 (SEQ ID NO: 35), AE78 (SEQ ID NO: 218), AE144 (SEQ ID NO: 36), AE144_2A (SEQ ID NO: 37), AE144_3B (SEQ ID NO: 38), AE144_4A (SEQ ID NO: 39), AE144_5A (SEQ ID NO: 40), AE144_6B (SEQ ID NO: 41), AG144 (SEQ ID NO: 42), AG144_A (SEQ ID NO: 43), AG144_B (SEQ ID NO: 44), AG144_C (SEQ ID NO: 45), AG144_F (SEQ ID NO: 46), AE288 (SEQ ID NO: 47), AE288_2 (SEQ ID NO: 48), AG288 (SEQ ID NO: 49), AE576 (SEQ ID NO: 50), AG576 (SEQ ID NO: 51), AE864 (SEQ ID NO: 52), AG864 (SEQ ID NO: 53), XTEN_AE72_2A_1 (SEQ ID NO:202), XTEN_AE72_2A_2 (SEQ ID NO:203), XTEN_AE72_3B_1 (SEQ ID NO:204), XTEN_AE72_3B_2 (SEQ ID NO:205), XTEN_AE72_4A_2 (SEQ ID NO:206), XTEN_AE72_5A_2 (SEQ ID NO:207), XTEN_AE72_6B_1 (SEQ ID NO: 208), XTEN_AE72_6B_2 (SEQ ID NO: 209), XTEN_AE72_1A_1 (SEQ ID NO: 210), XTEN_AE72_1A_2 (SEQ ID NO: 211), XTEN_AE144_1A (SEQ ID NO: 212), AE150 (SEQ ID NO: 213), AG150 (SEQ ID NO: 214), AE294 (SEQ ID NO: 215), AG294 (SEQ ID NO:216), and any combinations thereof. In a specific embodiment, the XTEN sequence is selected from the group consisting of AE72, AE144, and AE288. The amino acid sequences for certain XTEN sequences of the invention are shown in Table 2B.

TABLE 2B

| XTEN Sequences | |
|---|---|
| AE36<br>SEQ ID NO: 217 | GSPAGSPTSTEEGTSESATPESGPGSEPATSGSETP |
| AE42<br>SEQ ID NO: 34 | GAPGSPAGSPTSTEEGTSESATPESGPGSEPATSGSETPASS |
| AE72<br>SEQ ID NO: 35 | GAPTSESATPESGPGSEPATSGSETPGTSESATPESGPGSEPATSGSETPGTSE<br>SATPESGPGTSTEPSEGSAPGASS |
| AE78<br>SEQ ID NO: 218 | GAPTSESATPESGPGSEPATSGSETPGTSESATPESGPGSEPATSGSETPGTSE<br>SATPESGPGTSTEPSEGSAPGASS |
| AE144<br>SEQ ID NO: 36 | GSEPATSGSETPGTSESATPESGPGSEPATSGSETPGSPAGSPTSTEEGTSTEP<br>SEGSAPGSEPATSGSETPGSEPATSGSETPGSEPATSGSETPGTSTEPSEGSAP<br>GTSESAPESGPGSEPATSGSETPGTSTEPSEGSAP |
| AE144_2A<br>SEQ ID NO: 37 | TSTEPSEGSAPGSPAGSPTSTEEGTSTEPSEGSAPGTSTEPSEGSAPGTSESAT<br>PESGPGTSTEPSEGSAPGTSESATPESGPGSEPATSGSETPGTSTEPSEGSAPG<br>TSTEPSEGSAPGTSESATPESGPGTSESATPESGPG |
| AE144_3B<br>SEQ ID NO: 38 | SPAGSPTSTEEGTSESATPESGPGSEPATSGSETPGTSESATPESGPGTSTEPS<br>EGSAPGTSTEPSEGSAPGTSTEPSEGSAPGTSTEPSEGSAPGTSTEPSEGSAPG<br>TSTEPSEGSAPGSPAGSPTSTEEGTSTEPSEGSAPG |
| AE144_4A<br>SEQ ID NO: 39 | TSESATPESGPGSEPATSGSETPGTSESATPESGPGSEPATSGSETPGTSESAT<br>PESGPGTSTEPSEGSAPGTSESATPESGPGSPAGSPTSTEEGSPAGSPTSTEEG<br>SPAGSPTSTEEGTSESATPESGPGTSTEPSEGSAPG |
| AE144_5A<br>SEQ ID NO: 40 | TSESATPESGPGSEPATSGSETPGTSESATPESGPGSEPATSGSETPGTSESAT<br>PESGPGTSTEPSEGSAPGSPAGSPTSTEEGTSESATPESGPGSEPATSGSETPG<br>TSESATPESGPGSPAGSPTSTEEGSPAGSPTSTEEG |
| AE144_6B<br>SEQ ID NO: 41 | TSTEPSEGSAPGTSESATPESGPGTSESATPESGPGTSESATPESGPGSEPATS<br>GSETPGSEPATSGSETPGSPAGSPTSTEEGTSTEPSEGSAPGTSTEPSEGSAPG<br>SEPATSGSETPGTSESATPESGPGTSTEPSEGSAPG |
| AG144<br>SEQ ID NO:42 | GTPGSGTASSSPGSSTPSGATGSPGSSPSASTGTGPGSSPSASTGTGPGASPGT<br>SSTGSPGASPGTSSTGSPGSSTPSGATGSPGSSPSASTGTGPGASPGTSSTGSP<br>GSSPSASTGTGPGTPGSGTASSSPGSSTPSGATGSP |
| AG144_A<br>SEQ ID NO: 43 | GASPGTSSTGSPGSSPSASTGTGPGSSPSASTGTGPGTPGSGTASSSPGSSTPS<br>GATGSPGSSPSASTGTGPGASPGTSSTGSPGTPGSGTASSSPGSSTPSGATGSP<br>GTPGSGTASSSPGASPGTSSTGSPGASPGTSSTGSP |
| AG144_B<br>SEQ ID NO: 44 | GTPGSGTASSSPGSSTPSGATGSPGASPGTSSTGSPGTPGSGTASSSPGSSTPS<br>GATGSPGSSPSASTGTGPGSSPSASTGTGPGSSTPSGATGSPGSSTPSGATGSP<br>GASPGTSSTGSPGASPGTSSTGSPGASPGTSSTGSP |
| AG144_C<br>SEQ ID NO: 45 | GTPGSGTASSSPGASPGTSSTGSPGASPGTSSTGSPGASPGTSSTGSPGSSPSA<br>STGTGPGTPGSGTASSSPGASPGTSSTGSPGASPGTSSTGSPGASPGTSSTGSP<br>GSSTPSGATGSPGSSTPSGATGSPGASPGTSSTGSP |

TABLE 2B-continued

XTEN Sequences

AG144_F
SEQ ID NO: 46
GSSPSASTGTGPGSSPSASTGTGPGASPGTSSTGSPGASPGTSSTGSPGSSTPS
GATGSPGSSPSASTGTGPGASPGTSSTGSPGSSPSASTGTGPGTPGSGTASSSP
GSSTPSGATGSPGSSTPSGATGSPGASPGTSSTGSP

AE288
SEQ ID NO: 47
GTSESATPESGPGSEPATSGSETPGTSESATPESGPGSEPATSGSETPGTSESA
TPESGPGTSTEPSEGSAPGSPAGSPTSTEEGTSESATPESGPGSEPATSGSETP
GTSESATPESGPGSPAGSPTSTEEGSPAGSPTSTEEGTSTEPSEGSAPGTSESA
TPESGPGTSESATPESGPGTSESATPESGPGSEPATSGSETPGSEPATSGSETP
GSPAGSPTSTEEGTSTEPSEGSAPGTSTEPSEGSAPGSEPATSGSETPGTSESA
TPESGPGTSTEPSEGSAP

AE288_2
SEQ ID NO: 48
GSPAGSPTSTEEGTSESATPESGPGSEPATSGSETPGTSESATPESGPGTSTEP
SEGSAPGTSTEPSEGSAPGTSTEPSEGSAPGTSTEPSEGSAPGTSTEPSEGSAP
GTSTEPSEGSAPGSPAGSPTSTEEGTSTEPSEGSAPGTSESATPESGPGSEPAT
SGSETPGTSESATPESGPGSEPATSGSETPGTSESATPESGPGTSTEPSEGSAP
GTSESATPESGPGSPAGSPTSTEEGSPAGSPTSTEEGSPAGSPTSTEEGTSESA
TPESGPGTSTEPSEGSAP

AG288
SEQ ID NO: 49
PGASPGTSSTGSPGASPGTSSTGSPGTPGSGTASSSPGSSTPSGATGSPGTPGS
GTASSSPGSSTPSGATGSPGTPGSGTASSSPGSSTPSGATGSPGSSTPSGATGS
PGSSPSASTGTGPGSSPSASTGTGPGASPGTSSTGSPGTPGSGTASSSPGSSTP
SGATGSPGSSPSASTGTGPGSSPSASTGTGPGASPGTSSTGSPGASPGTSSTGS
PGSSTPSGATGSPGSSPSASTGTGPGASPGTSSTGSPGSSPSASTGTGPGTPGS
GTASSSPGSSTPSGATGS

AE576
SEQ ID NO: 50
GSPAGSPTSTEEGTSESATPESGPGTSTEPSEGSAPGSPAGSPTSTEEGTSTEP
SEGSAPGTSTEPSEGSAPGTSESATPESGPGSEPATSGSETPGSEPATSGSETP
GSPAGSPTSTEEGTSESATPESGPGTSTEPSEGSAPGTSTEPSEGSAPGSPAGS
PTSTEEGTSTEPSEGSAPGTSTEPSEGSAPGTSESATPESGPGTSTEPSEGSAP
GTSESATPESGPGSEPATSGSETPGTSTEPSEGSAPGTSTEPSEGSAPGTSESA
TPESGPGTSESATPESGPGSPAGSPTSTEEGTSESATPESGPGSEPATSGSETP
GTSESATPESGPGTSTEPSEGSAPGTSTEPSEGSAPGTSTEPSEGSAPGTSTEP
SEGSAPGTSTEPSEGSAPGTSTEPSEGSAPGSPAGSPTSTEEGTSTEPSEGSAP
GTSESATPESGPGSEPATSGSETPGTSESATPESGPGSEPATSGSETPGTSESA
TPESGPGTSTEPSEGSAPGTSESATPESGPGSPAGSPTSTEEGSPAGSPTSTEE
GSPAGSPTSTEEGTSESATPESGPGTSTEPSEGSAP

AG576
SEQ ID NO: 51
PGTPGSGTASSSPGSSTPSGATGSPGSSPSASTGTGPGSSPSASTGTGPGSSTP
SGATGSPGSSTPSGATGSPGASPGTSSTGSPGASPGTSSTGSPGASPGTSSTGS
PGTPGSGTASSSPGASPGTSSTGSPGASPGTSSTGSPGASPGTSSTGSPGSSPS
ASTGTGPGTPGSGTASSSPGASPGTSSTGSPGASPGTSSTGSPGASPGTSSTGS
PGSSTPSGATGSPGSSTPSGATGSPGASPGTSSTGSPGTPGSGTASSSPGSSTP
SGATGSPGSSTPSGATGSPGSSTPSGATGSPGSSPSASTGTGPGASPGTSSTGS
PGASPGTSSTGSPGTPGSGTASSSPGASPGTSSTGSPGASPGTSSTGSPGASPG
TSSTGSPGASPGTSSTGSPGTPGSGTASSSPGSSTPSGATGSPGTPGSGTASSS
PGSSTPSGATGSPGTPGSGTASSSPGSSTPSGATGSPGSSTPSGATGSPGSSPS
ASTGTGPGSSPSASTGTGPGASPGTSSTGSPGTPGSGTASSSPGSSTPSGATGS
PGSSPSASTGTGPGSSPSASTGTGPGASPGTSSTGS

AE864
SEQ ID NO: 52
GSPAGSPTSTEEGTSESATPESGPGTSTEPSEGSAPGSPAGSPTSTEEGTSTEP
SEGSAPGTSTEPSEGSAPGTSESATPESGPGSEPATSGSETPGSEPATSGSETP
GSPAGSPTSTEEGTSESATPESGPGTSTEPSEGSAPGTSTEPSEGSAPGSPAGS
PTSTEEGTSTEPSEGSAPGTSTEPSEGSAPGTSESATPESGPGTSTEPSEGSAP
GTSESATPESGPGSEPATSGSETPGTSTEPSEGSAPGTSTEPSEGSAPGTSESA
TPESGPGTSESATPESGPGSPAGSPTSTEEGTSESATPESGPGSEPATSGSETP
GTSESATPESGPGTSTEPSEGSAPGTSTEPSEGSAPGTSTEPSEGSAPGTSTEP
SEGSAPGTSTEPSEGSAPGTSTEPSEGSAPGSPAGSPTSTEEGTSTEPSEGSAP
GTSESATPESGPGSEPATSGSETPGTSESATPESGPGSEPATSGSETPGTSESA
TPESGPGTSTEPSEGSAPGTSESATPESGPGSPAGSPTSTEEGSPAGSPTSTEE
GSPAGSPTSTEEGTSESATPESGPGTSTEPSEGSAPGTSESATPESGPGSEPAT
SGSETPGTSESATPESGPGSEPATSGSETPGTSESATPESGPGTSTEPSEGSAP
GSPAGSPTSTEEGTSESATPESGPGSEPATSGSETPGTSESATPESGPGSPAGS
PTSTEEGSPAGSPTSTEEGTSTEPSEGSAPGTSESATPESGPGTSESATPESGP
GTSESATPESGPGSEPATSGSETPGSEPATSGSETPGSPAGSPTSTEEGTSTEP
SEGSAPGTSTEPSEGSAPGSEPATSGSETPGTSESATPESGPGTSTEPSEGSAP

AG864
SEQ ID NO: 53
GASPGTSSTGSPGSSPSASTGTGPGSSPSASTGTGPGTPGSGTASSSPGSSTPS
GATGSPGSSPSASTGTGPGASPGTSSTGSPGTPGSGTASSSPGSSTPSGATGSP
GTPGSGTASSSPGASPGTSSTGSPGASPGTSSTGSPGTPGSGTASSSPGSSTPS
GATGSPGASPGTSSTGSPGTPGSGTASSSPGSSTPSGATGSPGSSPSASTGTGP
GSSPSASTGTGPGSSTPSGATGSPGSSTPSGATGSPGASPGTSSTGSPGASPGT
SSTGSPGASPGTSSTGSPGTPGSGTASSSPGASPGTSSTGSPGASPGTSSTGSP
GASPGTSSTGSPGSSPSASTGTGPGTPGSGTASSSPGASPGTSSTGSPGASPGT
SSTGSPGASPGTSSTGSPGSSTPSGATGSPGSSTPSGATGSPGASPGTSSTGSP
GTPGSGTASSSPGSSTPSGATGSPGSSTPSGATGSPGSSTPSGATGSPGSSPSA
STGTGPGASPGTSSTGSPGASPGTSSTGSPGTPGSGTASSSPGASPGTSSTGSP
GASPGTSSTGSPGASPGTSSTGSPGASPGTSSTGSPGTPGSGTASSSPGSSTPS
GATGSPGTPGSGTASSSPGSSTPSGATGSPGTPGSGTASSSPGSSTPSGATGSP

TABLE 2B-continued

XTEN Sequences

| | |
|---|---|
| | GSSTPSGATGSPGSSPSASTGTGPGSSPSASTGTGPGASPGTSSTGSPGTPGSG<br>TASSSPGSSTPSGATGSPGSSPSASTGTGPGSSPSASTGTGPGASPGTSSTGSP<br>GASPGTSSTGSPGSSTPSGATGSPGSSPSASTGTGPGASPGTSSTGSPGSSPSA<br>STGTGPGTPGSGTASSSPGSSTPSGATGSPGSSTPSGATGSPGASPGTSSTGSP |
| XTEN_AE72_2A_1<br>SEQ ID NO: 202 | TSTEPSEGSAPGSPAGSPTSTEEGTSTEPSEGSAPGTSTEPSEGSAPGTSESAT<br>PESGPGTSTEPSEGSAPG |
| XTEN_AE72_2A_2<br>SEQ ID NO: 203 | TSESATPESGPGSEPATSGSETPGTSTEPSEGSAPGTSTEPSEGSAPGTSESAT<br>PESGPGTSESATPESGPG |
| XTEN_AE72_3B_1<br>SEQ ID NO: 204 | SPAGSPTSTEEGTSESATPESGPGSEPATSGSETPGTSESATPESGPGTSTEPS<br>EGSAPGTSTEPSEGSAPG |
| XTEN_AE72_3B_2<br>SEQ ID NO: 205 | TSTEPSEGSAPGTSTEPSEGSAPGTSTEPSEGSAPGTSTEPSEGSAPGSPAGSP<br>TSTEEGTSTEPSEGSAPG |
| XTEN_AE72_4A_2<br>SEQ ID NO: 206 | TSESATPESGPGSPAGSPTSTEEGSPAGSPTSTEEGSPAGSPTSTEEGTSESAT<br>PESGPGTSTEPSEGSAPG |
| XTEN_AE72_5A_2<br>SEQ ID NO: 207 | SPAGSPTSTEEGTSESATPESGPGSEPATSGSETPGTSESATPESGPGSPAGSP<br>TSTEEGSPAGSPTSTEEG |
| XTEN_AE72_6B_1<br>(SEQ ID NO: 208) | TSTEPSEGSAPGTSESATPESGPGTSESATPESGPGTSESATPESGPGSEPATS<br>GSETPGSEPATSGSETPG |
| XTEN_AE72_6B_2<br>SEQ ID NO: 209 | SPAGSPTSTEEGTSTEPSEGSAPGTSTEPSEGSAPGSEPATSGSETPGTSESAT<br>PESGPGTSTEPSEGSAPG |
| XTEN_AE72_1A_1<br>SEQ ID NO: 210 | SPAGSPTSTEEGTSESATPESGPGTSTEPSEGSAPGSPAGSPTSTEEGTSTEPS<br>EGSAPGTSTEPSEGSAPG |
| XTEN_AE72_1A_2<br>SEQ ID NO: 211 | TSESATPESGPGSEPATSGSETPGSEPATSGSETPGSPAGSPTSTEEGTSESAT<br>PESGPGTSTEPSEGSAPG |
| XTEN_AE144_1A<br>SEQ ID NO: 212 | SPAGSPTSTEEGTSESATPESGPGTSTEPSEGSAPGSPAGSPTSTEEGTSTEPS<br>EGSAPGTSTEPSEGSAPGTSESATPESGPGSEPATSGSETPGSEPATSGSETPG<br>SPAGSPTSTEEGTSESATPESGPGTSTEPSEGSAPG |
| AE150<br>SEQ ID NO: 213 | GAPGSEPATSGSETPGTSESATPESGPGSEPATSGSETPGSPAGSPTSTEEGTS<br>TEPSEGSAPGSEPATSGSETPGSEPATSGSETPGSEPATSGSETPGTSTEPSEG<br>SAPGTSESATPESGPGSEPATSGSETPGTSTEPSEGSAPASS |
| G150<br>SEQ ID NO: 214 | GAPGTPGSGTASSSPGSSTPSGATGSPGSSPSASTGTGPGSSPSASTGTGPGAS<br>PGTSSTGSPGASPGTSSTGSPGSSTPSGATGSPGSSPSASTGTGPGASPGTSST<br>GSPGSSPSASTGTGPGTPGSGTASSSPGSSTPSGATGSPASS |
| AE294<br>SEQ ID NO: 215 | GAPGTSESATPESGPGSEPATSGSETPGTSESATPESGPGSEPATSGSETPGTS<br>ESATPESGPGTSTEPSEGSAPGSPAGSPTSTEEGTSESATPESGPGSEPATSGS<br>ETPGTSESATPESGPGSPAGSPTSTEEGSPAGSPTSTEEGTSTEPSEGSAPGTS<br>ESATPESGPGTSESATPESGPGTSESATPESGPGSEPATSGSETPGSEPATSGS<br>ETPGSPAGSPTSTEEGTSTEPSEGSAPGTSTEPSEGSAPGSEPATSGSETPGTS<br>ESATPESGPGTSTEPSEGSAPASS |
| AG294<br>SEQ ID NO: 216 | GAPPGASPGTSSTGSPGASPGTSSTGSPGTPGSGTASSSPGSSTPSGATGSPGT<br>PGSGTASSSPGSSTPSGATGSPGTPGSGTASSSPGSSTPSGATGSPGSSTPSGA<br>TGSPGSSPSASTGTGPGSSPSASTGTGPGASPGTSSTGSPGTPGSGTASSSPGS<br>STPSGATGSPGSSPSASTGTGPGSSPSASTGTGPGASPGTSSTGSPGASPGTSS<br>TGSPGSSTPSGATGSPGSSPSASTGTGPGASPGTSSTGSPGSSPSASTGTGPGT<br>PGSGTASSSPGSSTPSGATGSASS |

In further embodiments, the XTEN sequence used in the invention affects the physical or chemical property, e.g., pharmacokinetics, of the fusion protein of the present invention. The XTEN sequence used in the present invention can exhibit one or more of the following advantageous properties: conformational flexibility, enhanced aqueous solubility, high degree of protease resistance, low immunogenicity, low binding to mammalian receptors, or increased hydrodynamic (or Stokes) radii. In a specific embodiment, the XTEN sequence linked to a FIX protein in this invention increases pharmacokinetic properties such as longer terminal half-life, increased bioavailability or increased area under the curve (AUC), so that the protein described herein stays in vivo for an increased period of time compared to wild type FIX. In further embodiments, the XTEN sequence used in this invention increases pharmacokinetic properties such as longer terminal half-life or increased area under the curve (AUC), so that FIX protein stays in vivo for an increased period of time compared to wild type FIX.

In some embodiments, the FIX protein exhibits an in vivo half-life at least about 1.5 fold, at least about 2-fold, at least about 3-fold, or at least about 4-fold greater than native FIX, rFIXFc, FIX R338L, or a corresponding FIX protein lacking the XTEN. In one particular embodiment, the FIX fusion protein can have an in vivo half-life more than 2-fold greater than a FIX polypeptide without the heterologous moiety.

In other embodiments, the FIX fusion protein exhibits an in vivo half-life which is at least about 5 hours, at least about 6 hours, at least about 7 hours, at least about 8 hours, at least about 9 hours, at least about 10 hours, at least about 11 hours, at least about 12 hours, at least about 13 hours, at least about 14 hours, at least about 15 hours, at least about 16 hours, at least about 17 hours, at least about 18 hours, at least about 19 hours, at least about 20 hours, at least about 21 hours, at least about 22 hours, at least about 23 hours, at least about 24 hours, at least about 25 hours, at least about 26 hours, at least about 27 hours, at least about 28 hours, at least about 29 hours, at least about 30 hours, at least about 31 hours, at east about 32 hours, at least about 33 hours, or at least about 34 hours longer than the in vivo half-life of a FIX polypeptide lacking the heterologous moiety.

A variety of methods and assays can be employed to determine the physical/chemical properties of proteins comprising the XTEN sequence. Such methods include, but are not limited to analytical centrifugation, EPR, HPLC-ion exchange, HPLC-size exclusion, HPLC-reverse phase, light scattering, capillary electrophoresis, circular dichroism, differential scanning calorimetry, fluorescence, HPLC-ion exchange, HPLC-size exclusion, IR, NMR, Raman spectroscopy, refractometry, and UV/Visible spectroscopy. Additional methods are disclosed in Amau et al., *Prot Expr and Purif* 48, 1-13 (2006).

Additional examples of XTEN sequences that can be used according to the present invention and are disclosed in US Patent Publication Nos. 2010/0239554 A1, 2010/0323956 A1, 2011/0046060 A1, 2011/0046061 A1, 2011/0077199 A1, or 2011/0172146 A1, or International Patent Publication Nos. WO 2010091122 A1, WO 2010144502 A2, WO 2010144508 A1, WO 2011028228 A1, WO 2011028229 A1, WO 2011028344 A2, WO 2014/011819 A2, or WO 2015/023891.

In some aspects, a FIX fusion protein comprises one or more XTEN sequences inserted within FIX, fused to the C-terminus of FIX, or both. In one embodiment, the one or more XTEN sequences are inserted within the GLA domain. In another embodiment, the one or more XTEN sequences are inserted within EGF1 domain. In other embodiments, the one or more XTEN sequences are inserted within EGF2. In still other embodiments, the one or more XTEN sequences are inserted within AP. In yet other embodiments, the one or more XTEN sequences are inserted within the catalytic domain. In some embodiments, the one or more XTEN sequences are fused to the C-terminus of the FIX.

In certain aspects, a FIX fusion protein comprises one XTEN sequence inserted at an insertion site listed in Table 7. In other aspects, a FIX fusion protein comprises two XTEN sequences inserted in two insertion sites listed in Table 7. In a particular embodiment, the two XTEN sequences are inserted in two insertion sites listed in Table 8. In certain aspects, a FIX fusion protein comprises three XTEN sequences inserted in three insertion sites listed in Table 7. In certain aspects, a FIX fusion protein comprises four XTEN sequences inserted in four insertion sites listed in Table 7. In certain aspects, a FIX fusion protein comprises five XTEN sequences inserted in five insertion sites listed in Table 7. In certain aspects, a FIX fusion protein comprises six XTEN sequences inserted in six insertion sites listed in Table 7. In some aspects, all the inserted XTEN sequences are identical. In other aspects, at least one of the inserted XTEN sequences is different from the rest of inserted XTEN sequences.

In some aspects, a FIX fusion protein comprises one XTEN sequence inserted within the FIX polypeptide at an insertion site corresponding to an amino acid selected from the group consisting of amino acid 103 of SEQ ID NO: 2, amino acid 105 of SEQ ID NO: 2, amino acid 142 of SEQ ID NO: 2, amino acid 149 of SEQ ID NO: 2, amino acid 162 of SEQ ID NO: 2, amino acid 166 of SEQ ID NO: 2, amino acid 174 of SEQ ID NO: 2, amino acid 224 of SEQ ID NO: 2, amino acid 226 of SEQ ID NO: 2, amino acid 228 of SEQ ID NO: 2, amino acid 413 of SEQ ID NO: 2, and any combination thereof, wherein the FIX fusion protein exhibits procoagulant activity. In some aspects, a FIX fusion protein comprises a second XTEN sequence within the FIX polypeptide at an insertion site corresponding to an amino acid selected from the group consisting of amino acid 103 of SEQ ID NO: 2, amino acid 105 of SEQ ID NO: 2, amino acid 142 of SEQ ID NO: 2, amino acid 149 of SEQ ID NO: 2, amino acid 162 of SEQ ID NO: 2, amino acid 166 of SEQ ID NO: 2, amino acid 174 of SEQ ID NO: 2, amino acid 224 of SEQ ID NO: 2, amino acid 226 of SEQ ID NO: 2, amino acid 228 of SEQ ID NO: 2, amino acid 413 of SEQ ID NO: 2, and any combination thereof or wherein the second XTEN is fused to the C-terminus of the FIX polypeptide, wherein the FIX fusion protein exhibits procoagulant activity. In one particular aspect, a FIX fusion protein comprises one XTEN sequence fused to the C-terminus of the FIX, wherein the XTEN comprises an amino acid sequence of longer than 42 amino acids and shorter than 144 amino acids in length.

II.B.2 Fc Regions or FcRn Binding Partners

In some embodiments, the at least one heterologous moiety is an Fc region (e.g., an FcRn binding partner) or a fragment thereof. In certain aspects, a FIX fusion protein of the invention comprises at least one Fc region (e.g., an FcRn binding partner) inserted within the FIX, fused to the C-terminus of the FIX, or both, wherein the FIX fusion protein has procoagulant activity and can be expressed in vivo or in vitro in a host cell. "Fc" or "Fc region" as used herein, can be a functional neonatal Fc receptor (FcRn) binding partner comprising an Fc domain, variant, or fragment thereof, unless otherwise specified. An FcRn binding partner is any molecule that can be specifically bound by the FcRn receptor with consequent active transport by the FcRn receptor of the FcRn binding partner, including, but not limited to, albumin. Thus, the term Fc includes any variants of IgG Fc that are functional. The region of the Fc portion of IgG that binds to the FcRn receptor has been described based on X-ray crystallography (Burmeister et al., Nature 372:379 (1994), incorporated herein by reference in its entirety). The major contact area of the Fc with the FcRn is near the junction of the CH2 and CH3 domains. Fc-FcRn contacts are all within a single Ig heavy chain. FcRn binding partners include, but are not limited to, whole IgG, the Fc fragment of IgG, and other fragments of IgG that include the complete binding region of FcRn. An Fc can comprise the CH2 and CH3 domains of an immunoglobulin with or without the hinge region of the immunoglobulin. Also included are Fc fragments, variants, or derivatives which maintain the desirable properties of an Fc region in a fusion protein, e.g., an increase in half-life, e.g., in vivo half-life. Myriad mutants, fragments, variants, and derivatives are described, e.g., in PCT Publication Nos. WO 2011/069164 A2, WO 2012/006623 A2, WO 2012/006635 A2, or WO 2012/006633 A2, all of which are incorporated herein by reference in their entireties.

The one or more Fc domains can be inserted within the FIX polypeptide, fused to the C-terminus of the polypeptide, or both. In some embodiments, the Fc domain is fused to the FIX polypeptide. In some embodiments, the Fc domain is fused to another heterologous moiety, such as an XTEN, which is inserted within the FIX or fused to the C-terminus of the XTEN. In some embodiments, the FIX fusion protein comprises a second Fc domain. The second Fc domain can be associated with the first Fc domain, e.g., through one or more covalent bonds.

II.B.3. Albumins

In some embodiments, the at least one heterologous moiety is an albumin, an albumin binding domain, or an albumin binding small molecule, or a variant, derivative, or fragment thereof. In certain aspects, a FIX fusion protein of the invention comprises at least one albumin polypeptide or fragment, variant, or derivative thereof inserted the FIX, fused to the C-terminus of the FIX, or both, wherein the FIX fusion protein has procoagulant activity and can be expressed in vivo or in vitro in a host cell. Human serum albumin (HSA, or HA), a protein of 609 amino acids in its full-length form, is responsible for a significant proportion of the osmotic pressure of serum and also functions as a carrier of endogenous and exogenous ligands. The term "albumin" as used herein includes full-length albumin or a functional fragment, variant, derivative, or analog thereof. Examples of albumin or the fragments or variants thereof are disclosed in US Pat. Publ. Nos. 2008/0194481A1, 2008/0004206 A1, 2008/0161243 A1, 2008/0261877 A1, or 2008/0153751 A1 or PCT Appl. Publ. Nos. 2008/033413 A2, 2009/058322 A1, or 2007/021494 A2, which are incorporated herein by reference in their entireties.

The albumin-binding polypeptides (ABPs) can compromise, without limitation, bacterial albumin-binding domains, albumin-binding peptides, or albumin-binding antibody fragments that can bind to albumin. Domain 3 from streptococcal protein G, as disclosed by Kraulis et al., FEBS Lett. 378:190-194 (1996) and Linhult et al., Protein Sci. 11:206-213 (2002) is an example of a bacterial albumin-binding domain. Examples of albumin-binding peptides include a series of peptides having the core sequence DICLPRWGCLW (SEQ ID NO: 163). See, e.g., Dennis et al., J. Biol. Chem. 2002, 277: 35035-35043 (2002). Examples of albumin-binding antibody fragments are disclosed in Muller and Kontermann, *Curr. Opin. Mol. Ther.* 9:319-326 (2007); Roovers et al., *Cancer Immunol. Immunother.* 56:303-317 (2007), and Holt et al., Prot. Eng. Design Sci., 21:283-288 (2008), which are incorporated herein by reference in their entireties.

In certain aspects, a FIX fusion protein of the invention comprises at least one attachment site for a non-polypeptide small molecule, variant, or derivative thereof that can bind to albumin (e.g., an albumin binding small molecule) inserted into the FIX, fused to the C-terminus of the FIX, or both, wherein the FIX fusion protein has procoagulant activity and can be expressed in vivo or in vitro in a host cell. For example, a FIX fusion protein of the invention can include one or more organic albumin-binding moieties attached in one or more insertion sites within the FIX, or fused to the C-terminus of the FIX, or both, wherein the FIX fusion protein has procoagulant activity and can be expressed in vivo or in vitro in a host cell. An example of such albumin-binding moieties is 2-(3-maleimidopropanamido)-6-(4-(4-iodophenyl)butanamido)hexanoate ("Albu" tag) as disclosed by Trussel et al., Bioconjugate Chem. 20:2286-2292 (2009).

In some embodiments, the albumin-binding polypeptide sequence is flanked at the C-terminus, the N-terminus, or both termini, by a Gly-Ser peptide linker sequence. In some embodiments, the Gly-Ser peptide linker is Gly$_4$Ser (SEQ ID NO: 161). In other embodiments, the Gly-Ser peptide linker is (Gly$_4$Ser)$_2$ (SEQ ID NO: 162).

II.B.4. CTP

In some embodiments, the at least one heterologous moiety is a C-terminal peptide (CTP) of the β subunit of human chorionic gonadotropin or fragment, variant, or derivative thereof. In certain aspects, a FIX fusion protein of the invention comprises at least one CTP or fragment, variant, or derivative thereof inserted into the FIX, fused to the C-terminus of the FIX, or both, wherein the FIX fusion protein has procoagulant activity and can be expressed in vivo or in vitro in a host cell. One or more CTP peptides inserted into a recombinant protein is known to increase the half-life of that protein. See, e.g., U.S. Pat. No. 5,712,122, incorporated by reference herein in its entirety. Exemplary CTP peptides include DPRFQDSSSSKAPPPSLPSPSR-LPGPSDTPIL (SEQ ID NO: 164) or SSSSKAP-PPSLPSPSRLPGPSDTPILPQ (SEQ ID NO: 165). See, e.g., U.S. Patent Application Publication No. US 2009/0087411 A1, incorporated by reference. In some embodiments, the CTP sequence is flanked at the C-terminus, the N-terminus, or both termini, by a Gly-Ser peptide linker sequence. In some embodiments, the Gly-Ser peptide linker is Gly$_4$Ser (SEQ ID NO: 161). In other embodiments, the Gly-Ser peptide linker is (Gly$_4$Ser)$_2$ (SEQ ID NO: 162).

II.B.5. PAS

In some embodiments, the at least one heterologous moiety is a PAS peptide. In certain aspects, a FIX fusion protein of the invention comprises at least one PAS peptide or fragment, variant, or derivative thereof inserted into the FIX, fused to the C-terminus of the FIX, or both, wherein the FIX fusion protein has procoagulant activity and can be expressed in vivo or in vitro in a host cell. A "PAS peptide" or "PAS sequence," as used herein, means an amino acid sequence comprising mainly alanine and serine residues or comprising mainly alanine, serine, and proline residues, the amino acid sequence forming random coil conformation under physiological conditions. Accordingly, the PAS sequence is a building block, an amino acid polymer, or a sequence cassette comprising, consisting essentially of, or consisting of alanine, serine, and proline which can be used as a part of the heterologous moiety in the fusion protein. An amino acid polymer also can form random coil conformation when residues other than alanine, serine, and proline are added as a minor constituent in the PAS sequence. By "minor constituent" is meant that that amino acids other than alanine, serine, and proline can be added in the PAS sequence to a certain degree, e.g., up to about 12%, i.e., about 12 of 100 amino acids of the PAS sequence, up to about 10%, up to about 9%, up to about 8%, about 6%, about 5%, about 4%, about 3%, i.e. about 2%, or about 1%, of the amino acids. The amino acids different from alanine, serine and proline can be selected from the group consisting of Arg, Asn, Asp, Cys, Gln, Glu, Gly, His, Ile, Leu, Lys, Met, Phe, Thr, Trp, Tyr, and Val. Under physiological conditions, a PAS peptide forms a random coil conformation and thereby can mediate an increased in vivo and/or in vitro stability to a recombinant protein of the invention, and has procoagulant activity.

Non-limiting examples of the PAS peptides include ASPAAPAPASPAAPAPSAPA (SEQ ID NO: 154), AAPASPAPAAPSAPAPAAPS (SEQ ID NO: 155), APSSPSPSAPSSPSPASPSS (SEQ ID NO: 156), APSSPSPSAPSSPSASPS (SEQ ID NO: 157), SSPSAPSPSSPASPSPSSPA (SEQ ID NO: 158), AASPAAPSAPPAAASPAAPSAPPA (SEQ ID NO: 159), ASAAAPAAASAAASAPSAAA (SEQ ID NO: 160) or any variants, derivatives, fragments, or combinations thereof. Additional examples of PAS sequences are known from, e.g., US Pat. Publ. No. 2010/0292130 A1 and PCT Appl. Publ. No. WO 2008/155134 A1. European issued patent EP2173890.

In some embodiments, the PAS sequence is flanked at the C-terminus, the N-terminus, or both termini, by a Gly-Ser peptide linker sequence. In some embodiments, the Gly-Ser peptide linker is Gly$_4$Ser (SEQ ID NO: 161). In other embodiments, the Gly/Ser peptide linker is (Gly$_4$Ser)$_2$ (SEQ ID NO: 162).

II.B.6. HAP

In some embodiments, the at least one heterologous moiety is a homo-amino acid polymer (HAP) peptide or fragment, variant, or derivative thereof. In certain aspects, a FIX fusion protein of the invention comprises at least one homo-amino acid polymer (HAP) peptide or fragment, variant, or derivative thereof inserted within the FIX, fused to the C-terminus of the FIX, or both, wherein the FIX fusion protein has procoagulant activity and can be expressed in vivo or in vitro in a host cell. A HAP peptide can comprise a repetitive sequence of glycine, which has at least 50 amino acids, at least 100 amino acids, 120 amino acids, 140 amino acids, 160 amino acids, 180 amino acids, 200 amino acids, 250 amino acids, 300 amino acids, 350 amino acids, 400 amino acids, 450 amino acids, or 500 amino acids in length. A HAP sequence is capable of extending half-life of a moiety fused to or linked to the HAP sequence. Non-limiting examples of the HAP sequence include, but are not limited to (Gly)$_n$, (Gly$_4$Ser)$_n$, or S(Gly$_4$Ser)$_n$, wherein n is 1, 2, 3, 4, 5, 6, 7, 8, 9, 10, 11, 12, 13, 14, 15, 16, 17, 18, 19, or 20. In one embodiment, n is 20, 21, 22, 23, 24, 25, 26, 26, 28, 29, 30, 31, 32, 33, 34, 35, 36, 37, 38, 39, or 40. In another embodiment, n is 50, 60, 70, 80, 90, 100, 110, 120, 130, 140, 150, 160, 170, 180, 190, or 200. See, e.g., Schlapschy M et al., Protein Eng. Design Selection, 20: 273-284 (2007).

II.B.7 Organic Polymers

In some embodiments, the at least one heterologous moiety is an organic polymer, e.g., a polyethylene glycol, a polysialic acid, or hydroxyethyl starch. In certain aspects, a FIX fusion protein of the invention comprises at least one attachment site for a non-polypeptide heterologous moiety or fragment, variant, or derivative thereof inserted into the FIX, fused to the C-terminus of the FIX, or both, wherein the FIX fusion protein has procoagulant activity and can be expressed in vivo or in vitro in a host cell. For example, a FIX fusion protein of the invention can include one or more polyethylene glycol (PEG) moieties attached within the FIX sequence, attached to the C-terminus of the FIX, or both, wherein the FIX fusion protein has procoagulant activity and can be expressed in vivo or in vitro in a host cell.

PEGylated FIX can refer to a conjugate formed between FIX and at least one polyethylene glycol (PEG) molecule. PEG is commercially available in a large variety of molecular weights and average molecular weight ranges. Typical examples of PEG average molecular weight ranges include, but are not limited to, about 200, about 300, about 400, about 600, about 1000, about 1300-1600, about 1450, about 2000, about 3000, about 3000-3750, about 3350, about 3000-7000, about 3500-4500, about 5000-7000, about 7000-9000, about 8000, about 10000, about 8500-11500, about 16000-24000, about 35000, about 40000, about 60000, and about 80000 daltons. These average molecular weights are provided merely as examples and are not meant to be limiting in any way.

A FIX fusion protein of the invention can be PEGylated to include mono- or poly-(e.g., 2-4) PEG moieties. PEGylation can be carried out by any of the PEGylation reactions known in the art. Methods for preparing a PEGylated protein product will generally include (i) reacting a polypeptide with polyethylene glycol (such as a reactive ester or aldehyde derivative of PEG) under conditions whereby the peptide of the invention becomes attached to one or more PEG groups; and (ii) obtaining the reaction product(s). In general, the optimal reaction conditions for the reactions will be determined case by case based on known parameters and the desired result.

There are a number of PEG attachment methods available to those skilled in the art, for example Malik F et al., *Exp. Hematol.* 20:1028-35 (1992); Francis, *Focus on Growth Factors* 3(2):4-10 (1992); European Pat. Pub. Nos. EP0401384, EP0154316, and EP0401384; and International Pat. Appl. Pub. Nos. WO92/16221 and WO95/34326. As a non-limiting example, FIX variants can contain cysteine substitutions at or near one or more insertion sites as described herein, and the cysteines can be further conjugated to PEG polymer. See Mei et al., *Blood* 116:270-279 (2010) and U.S. Pat. No. 7,632,921, which are incorporated herein by reference in their entireties.

In other embodiments, the organic polymer is a polysialic acid (PSA). PSAs are naturally occurring unbranched polymers of sialic acid produced by certain bacterial strains and in mammals in certain cells. See, e.g., Roth J. et al. (1993) in *Polysialic Acid: From Microbes to Man*, eds. Roth J., Rutishauser U., Troy F. A. (BirkhäuserVerlag, Basel, Switzerland), pp. 335-348. PSAs can be produced in various degrees of polymerization from n=about 80 or more sialic acid residues down to n=2 by limited acid hydrolysis or by digestion with neuraminidases, or by fractionation of the natural, bacterially derived forms of the polymer. There are a number of PSA attachment methods available to those skilled in the art, e.g., the same PEG attachment methods described above. In certain aspects, an activated PSA can also be attached to a cysteine amino acid residue on FIX. See, e.g., U.S. Pat. No. 5,846,951.

In other embodiments, the organic polymer is a hydroxyethyl starch (HES) polymer. In certain aspects, a FIX fusion protein of the invention comprises at least one HES polymer conjugated at one or more cite within the FIX, fused to the C-terminus of the FIX, or both, wherein the FIX fusion protein has procoagulant activity and can be expressed in vivo or in vitro in a host cell.

III. Polynucleotides, Vectors, Host Cells, and Methods of Making

The present invention further provides a polynucleotide encoding a FIX fusion protein described herein, an expression vector comprising the polynucleotide, a host cell comprising the polynucleotide or the vector, or methods of making the FIX fusion protein.

The polynucleotide encoding a FIX fusion protein can be a single nucleotide sequence, two nucleotide sequences, three nucleotide sequences, or more. In one embodiment, a single nucleotide sequence encodes a FIX fusion protein comprising a FIX polypeptide and a heterologous moiety (e.g., XTEN), e.g., a FIX fusion protein comprising a FIX polypeptide and an XTEN inserted within the FIX polypeptide, an Fc domain fused to the C terminus of the FIX polypeptide, and a second Fc domain fused to the FIX polypeptide by an optional linker. In another embodiment, the polynucleotide comprises two nucleotide sequences, the first nucleotide sequence encoding a FIX polypeptide and an XTEN inserted within the FIX polypeptide and the second nucleotide sequence encoding a heterologous moiety, e.g., Fc. In other embodiments, the polynucleotide comprises two nucleotide sequences, the first nucleotide sequence encoding a FIX polypeptide, an XTEN inserted within the FIX polypeptide, and an Fc domain fused to the FIX polypeptide, and the second nucleotide sequence encoding a second Fc domain. The encoded Fc domains can form a covalent bond after expression.

In some embodiments, the polynucleotide encoding the FIX fusion protein is codon-optimized.

As used herein, an expression vector refers to any nucleic acid construct which contains the necessary elements for the transcription and translation of an inserted coding sequence, or in the case of an RNA viral vector, the necessary elements for replication and translation, when introduced into an appropriate host cell. Expression vectors can include plasmids, phagemids, viruses, and derivatives thereof.

A gene expression control sequence as used herein is any regulatory nucleotide sequence, such as a promoter sequence or promoter-enhancer combination, which facilitates the efficient transcription and translation of the coding nucleic acid to which it is operably linked. The gene expression control sequence may, for example, be a mammalian or viral promoter, such as a constitutive or inducible promoter. Constitutive mammalian promoters include, but are not limited to, the promoters for the following genes: hypoxanthine phosphoribosyl transferase (HPRT), adenosine deaminase, pyruvate kinase, beta-actin promoter, and other constitutive promoters. Exemplary viral promoters which function constitutively in eukaryotic cells include, for example, promoters from the cytomegalovirus (CMV), simian virus (e.g., SV40), papilloma virus, adenovirus, human immunodeficiency virus (HIV), Rous sarcoma virus, cytomegalovirus, the long terminal repeats (LTR) of Moloney leukemia virus, and other retroviruses, and the thymidine kinase promoter of herpes simplex virus. Other constitutive promoters are known to those of ordinary skill in the art. The promoters useful as gene expression sequences of the invention also include inducible promoters. Inducible promoters are expressed in the presence of an inducing agent. For example, the metallothionein promoter is induced to promote transcription and translation in the presence of certain metal ions. Other inducible promoters are known to those of ordinary skill in the art.

For the purposes of this invention, numerous expression vector systems can be employed. These expression vectors are typically replicable in the host organisms either as episomes or as an integral part of the host chromosomal DNA. Expression vectors can include expression control sequences including, but not limited to, promoters (e.g., naturally-associated or heterologous promoters), enhancers, signal sequences, splice signals, enhancer elements, and transcription termination sequences. Preferably, the expression control sequences are eukaryotic promoter systems in vectors capable of transforming or transfecting eukaryotic host cells. Expression vectors can also utilize DNA elements which are derived from animal viruses such as bovine papilloma virus, polyoma virus, adenovirus, vaccinia virus, baculovirus, retroviruses (RSV, MMTV or MOMLV), cytomegalovirus (CMV), or SV40 virus. Others involve the use of polycistronic systems with internal ribosome binding sites.

Commonly, expression vectors contain selection markers (e.g., ampicillin-resistance, hygromycin-resistance, tetracycline resistance or neomycin resistance) to permit detection of those cells transformed with the desired DNA sequences (see, e.g., Itakura et al., U.S. Pat. No. 4,704,362). Cells which have integrated the DNA into their chromosomes can be selected by introducing one or more markers which allow selection of transfected host cells. The marker can provide for prototrophy to an auxotrophic host, biocide resistance (e.g., antibiotics) or resistance to heavy metals such as copper. The selectable marker gene can either be directly linked to the DNA sequences to be expressed, or introduced into the same cell by cotransformation.

An example of a vector useful for expressing an optimized FIX sequence is NEOSPLA (U.S. Pat. No. 6,159,730). This vector contains the cytomegalovirus promoter/enhancer, the mouse beta globin major promoter, the SV40 origin of replication, the bovine growth hormone polyadenylation sequence, neomycin phosphotransferase exon 1 and exon 2, the dihydrofolate reductase gene and leader sequence. This vector has been found to result in very high level expression of antibodies upon incorporation of variable and constant region genes, transfection in cells, followed by selection in G418 containing medium and methotrexate amplification. Vector systems are also taught in U.S. Pat. Nos. 5,736,137 and 5,658,570, each of which is incorporated by reference in its entirety herein. This system provides for high expression levels, e.g., >30 pg/cell/day. Other exemplary vector systems are disclosed e.g., in U.S. Pat. No. 6,413,777.

In other embodiments the polypeptides of the instant invention are expressed using polycistronic constructs. In these expression systems, multiple gene products of interest such as multiple polypeptides of multimer binding protein can be produced from a single polycistronic construct. These systems advantageously use an internal ribosome entry site (IRES) to provide relatively high levels of polypeptides in eukaryotic host cells. Compatible IRES sequences are disclosed in U.S. Pat. No. 6,193,980 which is also incorporated herein.

More generally, once the vector or DNA sequence encoding a polypeptide has been prepared, the expression vector can be introduced into an appropriate host cell. That is, the host cells can be transformed. Introduction of the plasmid into the host cell can be accomplished by various techniques well known to those of skill in the art, as discussed above. The transformed cells are grown under conditions appropriate to the production of the FIX polypeptide, and assayed for FIX polypeptide synthesis. Exemplary assay techniques include enzyme-linked immunosorbent assay (ELISA), radioimmunoassay (RIA), or flourescence-activated cell sorter analysis (FACS), immunohistochemistry, and the like.

In descriptions of processes for isolation of polypeptides from recombinant hosts, the terms "cell" and "cell culture" are used interchangeably to denote the source of polypeptide unless it is clearly specified otherwise. In other words, recovery of polypeptides from the "cells" can mean either from spun down whole cells, or from the cell culture containing both the medium and the suspended cells.

The host cell line used for protein expression is preferably of mammalian origin; most preferably of human or mouse origin. Exemplary host cell lines have been described above. In one embodiment of the method to produce a polypeptide with FIX activity, the host cell is a HEK293 cell. In another embodiment of the method to produce a polypeptide with FIX activity, the host cell is a CHO cell.

Genes encoding the polypeptides of the invention can also be expressed in non-mammalian cells such as bacteria or yeast or plant cells. In this regard it will be appreciated that various unicellular non-mammalian microorganisms such as bacteria can also be transformed; i.e., those capable of being grown in cultures or fermentation. Bacteria, which are susceptible to transformation, include members of the enterobacteriaceae, such as strains of *Escherichia coli* or

*Salmonella*; Bacillaceae, such as *Bacillus subtilis*; Pneumococcus; *Streptococcus*, and *Haemophilus influenzae*. It will further be appreciated that, when expressed in bacteria, the polypeptides typically become part of inclusion bodies. The polypeptides must be isolated, purified and then assembled into functional molecules.

Alternatively, polynucleotide sequences of the invention can be incorporated in transgenes for introduction into the genome of a transgenic animal and subsequent expression in the milk of the transgenic animal (see, e.g., Deboer et al., U.S. Pat. No. 5,741,957, Rosen, U.S. Pat. No. 5,304,489, and Meade et al., U.S. Pat. No. 5,849,992). Suitable transgenes include coding sequences for polypeptides in operable linkage with a promoter and enhancer from a mammary gland specific gene, such as casein or beta lactoglobulin.

In vitro production allows scale-up to give large amounts of the desired polypeptides. Techniques for mammalian cell cultivation under tissue culture conditions are known in the art and include homogeneous suspension culture, e.g., in an airlift reactor or in a continuous stirrer reactor, or immobilized or entrapped cell culture, e.g., in hollow fibers, microcapsules, on agarose microbeads or ceramic cartridges. If necessary and/or desired, the solutions of polypeptides can be purified by the customary chromatography methods, for example gel filtration, ion-exchange chromatography, chromatography over DEAE-cellulose or (immuno-)affinity chromatography, e.g., after preferential biosynthesis of a synthetic hinge region polypeptide or prior to or subsequent to the HIC chromatography step described herein. An affinity tag sequence (e.g., a His(6) tag) can optionally be attached or included within the polypeptide sequence to facilitate downstream purification.

Once expressed, the FIX protein can be purified according to standard procedures of the art, including ammonium sulfate precipitation, affinity column chromatography, HPLC purification, gel electrophoresis and the like (see generally Scopes, Protein Purification (Springer-Verlag, N.Y., (1982)). Substantially pure proteins of at least about 90% to 95% homogeneity are preferred, and 98% to 99% or more homogeneity most preferred, for pharmaceutical uses.

In one embodiment, the host cell is a eukaryotic cell. As used herein, a eukaryotic cell refers to any animal or plant cell having a definitive nucleus. Eukaryotic cells of animals include cells of vertebrates, e.g., mammals, and cells of invertebrates, e.g., insects. Eukaryotic cells of plants specifically can include, without limitation, yeast cells. A eukaryotic cell is distinct from a prokaryotic cell, e.g., bacteria.

In certain embodiments, the eukaryotic cell is a mammalian cell. A mammalian cell is any cell derived from a mammal. Mammalian cells specifically include, but are not limited to, mammalian cell lines. In one embodiment, the mammalian cell is a human cell. In another embodiment, the mammalian cell is a HEK 293 cell, which is a human embryonic kidney cell line. HEK 293 cells are available as CRL-1533 from American Type Culture Collection, Manassas, Va., and as 293-H cells, Catalog No. 11631-017 or 293-F cells, Catalog No. 11625-019 from Invitrogen (Carlsbad, Calif.). In some embodiments, the mammalian cell is a PER.C6® cell, which is a human cell line derived from retina. PER.C6® cells are available from Crucell (Leiden, The Netherlands). In other embodiments, the mammalian cell is a Chinese hamster ovary (CHO) cell. CHO cells are available from American Type Culture Collection, Manassas, Va. (e.g., CHO-Ki; CCL-61). In still other embodiments, the mammalian cell is a baby hamster kidney (BHK) cell. BHK cells are available from American Type Culture Collection, Manassas, Va. (e.g., CRL-1632). In some embodiments, the mammalian cell is a HKB11 cell, which is a hybrid cell line of a HEK293 cell and a human B cell line. Mei et al., Mol. Biotechnol. 34(2): 165-78 (2006).

In still other embodiments, transfected cells are stably transfected. These cells can be selected and maintained as a stable cell line, using conventional techniques known to those of skill in the art.

Host cells containing DNA constructs of the protein are grown in an appropriate growth medium. As used herein, the term "appropriate growth medium" means a medium containing nutrients required for the growth of cells. Nutrients required for cell growth may include a carbon source, a nitrogen source, essential amino acids, vitamins, minerals, and growth factors. Optionally, the media can contain one or more selection factors. Optionally the media can contain bovine calf serum or fetal calf serum (FCS). In one embodiment, the media contains substantially no IgG. The growth medium will generally select for cells containing the DNA construct by, for example, drug selection or deficiency in an essential nutrient which is complemented by the selectable marker on the DNA construct or co-transfected with the DNA construct. Cultured mammalian cells are generally grown in commercially available serum-containing or serum-free media (e.g., MEM, DMEM, DMEM/F12). In one embodiment, the medium is CD293 (Invitrogen, Carlsbad, Calif.). In another embodiment, the medium is CD17 (Invitrogen, Carlsbad, Calif.). Selection of a medium appropriate for the particular cell line used is within the level of those ordinary skilled in the art.

In some embodiments, the nucleic acid, vector, or host cell further comprises an additional nucleotide which encodes a protein convertase. The protein convertase can be selected from the group consisting of proprotein convertase subtilisin/kexin type 5 (PCSK5 or PC5), proprotein convertase subtilisin/kexin type 7 (PCSK7 or PC5), a yeast Kex 2, proprotein convertase subtilisin/kexin type 3 (PACE or PCSK3), and two or more combinations thereof. In some embodiments, the protein convertase is PACE, PC5, or PC7. In a specific embodiment, the protein convertase is PC5 or PC7. See International Appl. Publ. No. WO 2012/006623, which is incorporated herein by reference. In another embodiment, the protein convertase is PACE/Furin.

In certain aspects, the present invention relates to the FIX fusion protein produced by the methods described herein.

In certain aspects, host cells of the invention can express the FIX fusion protein in vivo or in vitro. In vitro production allows scale-up to give large amounts of the desired altered polypeptides of the invention. a FIX fusion protein can be produced by culturing the host cells described herein under conditions in which the FIX fusion protein is expressed. Techniques for mammalian cell cultivation under tissue culture conditions are known in the art and include homogeneous suspension culture, e.g. in an airlift reactor or in a continuous stirrer reactor, or immobilized or entrapped cell culture, e.g. in hollow fibers, microcapsules, on agarose microbeads or ceramic cartridges. If necessary and/or desired, the solutions of polypeptides can be purified by the customary chromatography methods, for example gel filtration, ion-exchange chromatography, hydrophobic interaction chromatography (HIC, chromatography over DEAE-cellulose or affinity chromatography. In other aspects, the host cells express the FIX fusion protein in vivo.

In one embodiment, the invention includes a method of making a FIX fusion protein comprising inserting a heterologous moiety in an insertion site, fusing a heterologous moiety to the C-terminus of the FIX, or both as described herein, wherein the FIX fusion protein exhibits procoagulant activity.

In another embodiment, the invention includes a method of increasing half-life of a FIX protein without eliminating or reducing procoagulant activity of the FIX protein, comprising inserting a heterologous moiety in an insertion site, fusing a heterologous moiety to the C-terminus of the FIX, or both as described herein, wherein the FIX fusion protein exhibits procoagulant activity and increased half-life compared to the FIX protein without the heterologous moiety.

In other embodiments, the invention provides a method of constructing a FIX fusion protein comprising designing a nucleotide sequence encoding the FIX fusion protein comprising at least one heterologous moiety in an insertion site, fused to the C-terminus of the FIX, or both as described herein.

In certain embodiments, the present invention includes a method of increasing expression of a FIX fusion protein comprising inserting a heterologous moiety in an insertion site, fused to the C-terminus of the FIX, or both as described herein, wherein the FIX fusion protein exhibits procoagulant activity In still other embodiments, the invention provides a method of retaining procoagulant activity of a FIX fusion protein, comprising inserting a heterologous moiety in an insertion site, fusing a heterologous moiety to the C-terminus of the FIX, or both as described herein, wherein the FIX fusion protein exhibits procoagulant activity.

IV. Pharmaceutical Compositions and Methods of Treatment

The present invention further provides a method for preventing, treating, ameliorating, or managing a clotting disease or condition or a bleeding condition in a human subject in need thereof using a pharmaceutical composition comprising a FIX fusion protein of the invention. An exemplary method comprises administering to the subject in need thereof a therapeutically effective amount of a pharmaceutical composition/formulation comprising a FIX fusion protein of the invention. In other aspects, a composition comprising a DNA encoding the fusion protein of the invention can be administered to a subject in need thereof. In certain aspects of the invention, a cell expressing a FIX fusion protein of the invention can be administered to a subject in need thereof. In certain aspects of the invention, the pharmaceutical composition comprises (i) a FIX fusion protein, (ii) an isolated nucleic acid encoding a FIX fusion protein, (iii) a vector comprising a nucleic acid encoding a FIX fusion protein, (iv) a cell comprising an isolated nucleic acid encoding a FIX fusion protein and/or a vector comprising a nucleic encoding a FIX fusion protein, or (v) a combination thereof, and the pharmaceutical compositions further comprises an acceptable excipient or carrier.

The FIX fusion protein of the invention can be administered to a patient intravenously, subcutaneously, or orally. In certain embodiments, the FIX fusion protein is administered to a subject by intravenous injection. In other embodiments, the FIX fusion protein is administered to a subject by subcutaneous injection. The injections can comprise a single bolus. Subjects may receive more than one injection.

The fusion proteins of the invention can be used prophylactically. As used herein the term "prophylactic treatment" refers to the administration of a molecule prior to a bleeding episode. In one embodiment, the subject in need of a general hemostatic agent is undergoing, or is about to undergo, surgery. The fusion protein of the invention can be administered prior to or after surgery as a prophylactic. The fusion protein of the invention can be administered during or after surgery to control an acute bleeding episode. The surgery can include, but is not limited to, liver transplantation, liver resection, dental procedures, or stem cell transplantation.

The fusion protein of the invention is also used for on-demand treatment. The term "on-demand treatment" refers to the administration of a fusion protein in response to symptoms of a bleeding episode or before an activity that may cause bleeding. In one aspect, the on-demand treatment is given to a subject when bleeding starts, such as after an injury, or when bleeding is expected, such as before surgery. In another aspect, the on-demand treatment is given prior to activities that increase the risk of bleeding, such as contact sports.

In other embodiments, the fusion protein is used to control, ameliorate, or treat an acute bleeding episode. In other embodiments, the FIX fusion protein exhibits one or more pharmacokinetic parameters compared to a corresponding FIX protein without the heterologous moiety. PK parameters can be based on FIX antigen level (often denoted parenthetically herein as "antigen") or FIX activity level (often denoted parenthetically herein as "activity"). In the literature, PK parameters are often based on FIX activity level due to the presence in the plasma of some subjects of endogenous, inactive FIX, which interferes with the ability to measure administered (i.e., exogenous) FIX using antibody against FIX. However, when FIX is administered as part of an Fc fusion protein as provided herein, administered (i.e., exogenous) FIX antigen can be accurately measured using antibody to the heterologous polypeptide. In addition, certain PK parameters can be based on model predicted data (often denoted parenthetically herein as "model predicted") or on observed data (often denoted parenthetically herein as "observed"), and preferably are based on observed data.

The FIX fusion protein can be administered to a subject through any means known in the art. For example, the FIX fusion protein can be administered through topical (e.g., transdermal or ocular), oral, buccal, nasal, vaginal, rectal, or parenteral (e.g., subcutaneous, intradermal, intravascular/intravenous, intramuscular, spinal, intracranial, intrathecal, intraocular, periocular, intraorbital, intrasynovial, and intraperitoneal injection) administration. In one particular embodiment, the FIX fusion protein is administered via a subcutaneous injection. The subcutaneous injection can include one or more bolus, including, for example, a single bolus of a dose of the FIX fusion protein. Alternatively, the FIX fusion protein can be administered via intravenous injection.

The dose of the FIX fusion protein can vary depending on the nature of the particular fusion protein and the nature of the subject's condition. In some embodiments, the dose of the FIX fusion protein can comprise between 1 and 1000 IU/kg of the FIX fusion protein.

The bleeding condition can be caused by a blood coagulation disorder. A blood coagulation disorder can also be referred to as a coagulopathy. In one example, the blood coagulation disorder, which can be treated with a pharmaceutical composition of the current disclosure, is hemophilia. In another example, the blood coagulation disorder, which can be treated with a pharmaceutical composition of the present disclosure is hemophilia B.

In some embodiments, the type of bleeding associated with the bleeding condition is selected from hemarthrosis, muscle bleed, oral bleed, hemorrhage, hemorrhage into muscles, oral hemorrhage, trauma, trauma capitis, gastrointestinal bleeding, intracranial hemorrhage, intra-abdominal hemorrhage, intrathoracic hemorrhage, bone fracture, central nervous system bleeding, bleeding in the retropharyngeal space, bleeding in the retroperitoneal space, and bleeding in the illiopsoas sheath.

In other embodiments, the subject suffering from bleeding condition is in need of treatment for surgery, including, e.g., surgical prophylaxis or pen-operative management. In one example, the surgery is selected from minor surgery and major surgery. Exemplary surgical procedures include tooth extraction, tonsillectomy, inguinal herniotomy, synovectomy, craniotomy, osteosynthesis, trauma surgery, intracranial surgery, intra-abdominal surgery, intrathoracic surgery, joint replacement surgery (e.g., total knee replacement, hip replacement, and the like), heart surgery, and caesarean section.

In another example, the subject is concomitantly treated with Factor VIII. Because the compounds of the invention are capable of activating FIXa, they could be used to pre-activate the FIXa polypeptide before administration of the FIXa to the subject.

The methods of the invention may be practiced on a subject in need of prophylactic treatment or on-demand treatment.

Pharmaceutical compositions comprising a FIX fusion protein of the invention may be formulated for any appropriate manner of administration, including, for example, topical (e.g., transdermal or ocular), oral, buccal, nasal, vaginal, rectal or parenteral administration.

The term parenteral as used herein includes subcutaneous, intradermal, intravascular (e.g., intravenous), intramuscular, spinal, intracranial, intrathecal, intraocular, periocular, intraorbital, intrasynovial and intraperitoneal injection, as well as any similar injection or infusion technique. In particular, the pharmaceutical compositions comprising a FIX fusion protein of the invention may be formulated for subcutaneous administration. The composition can be also for example a suspension, emulsion, sustained release formulation, cream, gel or powder. The composition can be formulated as a suppository, with traditional binders and carriers such as triglycerides.

In one example, the pharmaceutical formulation is a liquid formulation, e.g., a buffered, isotonic, aqueous solution. In another example, the pharmaceutical composition has a pH that is physiologic, or close to physiologic. In other examples, the aqueous formulation has a physiologic or close to physiologic osmolarity and salinity. It can contain sodium chloride and/or sodium acetate. In some examples, the composition of the present invention is lyophilized.

A fusion protein thereof of the invention can be produced in vivo in a mammal, e.g., a human patient, using a gene therapy approach to treatment of a bleeding disease or disorder selected from the group consisting of a bleeding coagulation disorder, hemarthrosis, muscle bleed, oral bleed, hemorrhage, hemorrhage into muscles, oral hemorrhage, trauma, trauma capitis, gastrointestinal bleeding, intracranial hemorrhage, intra-abdominal hemorrhage, intrathoracic hemorrhage, bone fracture, central nervous system bleeding, bleeding in the retropharyngeal space, bleeding in the retroperitoneal space, and bleeding in the illiopsoas sheath would be therapeutically beneficial. In one embodiment, the bleeding disease or disorder is hemophilia. In another embodiment, the bleeding disease or disorder is hemophilia B. This involves administration of a suitable fusion protein-encoding nucleic acid operably linked to suitable expression control sequences. In certain embodiment, these sequences are incorporated into a viral vector. Suitable viral vectors for such gene therapy include adenoviral vectors, lentiviral vectors, baculoviral vectors, Epstein Barr viral vectors, papovaviral vectors, vaccinia viral vectors, herpes simplex viral vectors, and adeno associated virus (AAV) vectors. The viral vector can be a replication-defective viral vector. In other embodiments, an adenoviral vector has a deletion in its E1 gene or E3 gene. When an adenoviral vector is used, the mammal may not be exposed to a nucleic acid encoding a selectable marker gene. In other embodiments, the sequences are incorporated into a non-viral vector known to those skilled in the art.

The practice of the present invention will employ, unless otherwise indicated, conventional techniques of cell biology, cell culture, molecular biology, transgenic biology, microbiology, recombinant DNA, and immunology, which are within the skill of the art. Such techniques are explained fully in the literature. See, for example, Molecular Cloning A Laboratory Manual, 2nd Ed., Sambrook et al., ed., Cold Spring Harbor Laboratory Press: (1989); Molecular Cloning: A Laboratory Manual, Sambrook et al., ed., Cold Springs Harbor Laboratory, New York (1992), DNA Cloning, D. N. Glover ed., Volumes I and II (1985); Oligonucleotide Synthesis, M. J. Gait ed., (1984); Mullis et al. U.S. Pat. No. 4,683,195; Nucleic Acid Hybridization, B. D. Hames & S. J. Higgins eds. (1984); Transcription And Translation, B. D. Hames & S. J. Higgins eds. (1984); Culture Of Animal Cells, R. I. Freshney, Alan R. Liss, Inc., (1987); Immobilized Cells And Enzymes, IRL Press, (1986); B. Perbal, A Practical Guide To Molecular Cloning (1984); the treatise, Methods In Enzymology, Academic Press, Inc., N.Y.; Gene Transfer Vectors For Mammalian Cells, J. H. Miller and M. P. Calos eds., Cold Spring Harbor Laboratory (1987); Methods In Enzymology, Vols. 154 and 155 (Wu et al. eds.); Immunochemical Methods In Cell And Molecular Biology, Mayer and Walker, eds., Academic Press, London (1987); Handbook Of Experimental Immunology, Volumes I-IV, D. M. Weir and C. C. Blackwell, eds., (1986); Manipulating the Mouse Embryo, Cold Spring Harbor Laboratory Press, Cold Spring Harbor, N.Y., (1986); and in Ausubel et al., Current Protocols in Molecular Biology, John Wiley and Sons, Baltimore, Md. (1989).

Standard reference works setting forth general principles of immunology include Current Protocols in Immunology, John Wiley & Sons, New York; Klein, J., Immunology: The Science of Self-Nonself Discrimination, John Wiley & Sons, New York (1982); Roitt, I., Brostoff, J. and Male D., Immunology, 6$^{th}$ ed. London: Mosby (2001); Abbas A., Abul, A. and Lichtman, A., Cellular and Molecular Immunology, Ed. 5, Elsevier Health Sciences Division (2005); and Harlow and Lane, Antibodies: A Laboratory Manual, Cold Spring Harbor Press (1988).

Having now described the present invention in detail, the same will be more clearly understood by reference to the following examples, which are included herewith for purposes of illustration only and are not intended to be limiting of the invention.

EXAMPLES

Example 1: Identification of Active FIX-XTEN Variants

FIX fusion proteins comprising a FIX polypeptide with one or more XTEN insertions to improve the properties of the FIX protein were constructed. However, the location, length, composition and number of XTEN modifications can be readily varied, and impact of these modifications on the activity and clearance of FIX can be evaluated.

The present example aims to identify sites in FIX that can accommodate the introduction of XTENs without abrogating FIX activity and apply this approach to both otherwise non-modified FIX and a recombinant FIX-Fc fusion protein.
Methods The FIX polypeptide coding sequence was ligated into expression vector pcDNA4/myc-His C (INVITROGEN™, Carlsbad, Calif.) between the BsiWI and PmeI sites following introduction of a Kozak translation initiation sequence (GCCGCCACC) immediately 5' to the ATG codon encoding the start Met residue.

HEK293F cells (INVITROGEN™, Carlsbad, Calif.) were transfected with plasmid using polyethyleneimine (PEI, Polysciences Inc., Warrington, Pa.). The transiently transfected cells were grown in FREESTYLE™ 293 medium or a mixture of FREESTYLE™ 293 and CD OPTICHO™ media (INVITROGEN™, Carlsbad, Calif.). The cell culture medium was harvested 5 days after transfection and analyzed for FIX activity by chromogenic or aPTT FIX activity assay.

The chromogenic FIX activity was measured using the BIOPHEN Factor IX kit from Aniara and all incubations were performed on a 37° C. plate heater with shaking. Cell culture harvests from transient transfection media of FIX-XTEN variants from 6 well plates were diluted to the desired FIX activity range using Tris-BSA dilution buffer (R4). FIX standards were also prepared in Tris-BSA dilution buffer. The standards, diluted cell culture samples, and a pooled normal human plasma assay control (50 pt/well) were added to IMMULON® 2HB 96-well plates in duplicates. Human Factor X, FVIII:C and fibrin polymerization inhibitor (50 µL), 50 µL of mixture of Factor XIa, with thrombin, phospholipids and Calcium, and 50 µL of Factor Xa specific Chromogenic substrate (SXa-11) were added sequentially into each well, with 2 minutes incubation between each addition. After incubating with the substrate, 50 µL of 20% acetic acid was added to terminate the color reaction, and the absorbance at 405 nm was measured with a SPECTRA-MAX® plus (MOLECULAR DEVICES®) instrument. Data analysis was performed using SOFTMAX® Pro Software (version 5.2).

A one stage activated partial thromboplastin time (aPTT) coagulation assay was employed to assess FIX activity. The FIX-XTEN aPTT activity was measured using the SYSMEX® CA-1500 instrument (Siemens Healthcare Diagnostics Inc., Tarrytown, N.Y.). To create a standard curve for the assay, WHO Factor IX standard was diluted with mock transfection media with matching culture media concentration as the testing sample. Cell culture harvests from transient transfection media of FIX-XTEN variants from 6 well plates were diluted to the desired FIX activity range using mock transfection media. After dilution, the aPTT assay was performed using the Sysmex instrument as follow: 50 µl of diluted standards and samples were mixed with 50 µl Siemens human FIX depleted Plasma and then 50 µl of Siemens Actin FSL (ellagic acid) activator. The mixture was incubated for 1 min. Subsequently, 50 µl of Siemens CaCl$_2$) was added to the mixture and the mixture was incubated for 240 seconds. The clotting time was measured immediately following this incubation. To determine test samples FIX activity, the clotting times of the standards were plotted using log scales to extrapolate the equation between clotting time and FIX activity, and FIX-XTEN activity was then calculated against the standard curve.
Selection of Insertion Sites FIX structures from Protein Data Bank, 1PFX, 1IXA, 1CFI, 1CFH, 1EDM, 3LC3, 3LC5, 1RFN, 1X7A and 3KCG, were analyzed to select sites in FIX for XTEN insertion. XTEN insertion within the GLA domain was avoided due to the essential role of the GLA domain in anchoring FIX to phospholipid surfaces and subendothelial type IV collagen. XTEN insertion sites were selected by analysis of available FIX structures in the Protein Data Bank in conjunction with the following criteria: 1) calculated accessible surface area by algorithm software ASA View (www.abren.net/asaview/) and Get Area (curie.utmb.edu/getarea.html), 2) solvent accessibility assessed by hydrogen/deuterium exchange mass spectrometry (H/DX-MS), 3) exclusion of sites within defined secondary structural elements, 4) preference for positions with significant interspecies protein sequence variability, and 5) exclusion of sites proximal to known hemophilia B mutations.

Four sites in the EGF1 domain, 5 sites in the EGF2 domain, 2 sites in the linker region between the AP domain and the EGF2 domain, 4 sites in the AP (activation peptide) domain and 18 sites in the catalytic domain were selected for insertion of XTEN (Table 6).

TABLE 6

Potential sites for XTEN insertion into FIX (insertion at the c-terminus of the indicated residue)

| FIX Domain | Selected Sites |
| --- | --- |
| EGF1 | E52, G59, I66, K80 |
| EGF2 | D85, N89, A103, N105, E113 |
| Linker | P129, K142 |
| AP | V149, E162, D166, S174 |
| Catalytic | K188, V202, E224, G226, K228, T230, E240, H257, K265, E277, S283, D292, K316, K341, H354, K392, R403, K413 |

Activity Screen of 42-Amino Acid XTEN Insertions and C-Terminal Fusion

The highly active FIX Padua variant (R338L) was used as a scaffold to counter potential FIX activity loss due to reduced activity caused by the introduction of XTENs. A 42-residue XTEN element (AE42) was inserted at sites selected by using the criteria above or fused at the C-terminus of FIX. FIX activities of these variants were evaluated in conditioned medium of transfected HEK293 cells as described above. FIX activities of FIX-AE42s are shown as percentage of the base construct without XTEN, FIX-R338L (FIG. 1).

XTEN insertion was tolerated at limited sites as determined by FIX chromogenic assay (FIG. 1 and Table 7). A total of 33 sites in FIX were selected and evaluated by insertion of AE-42. Of these, two in the EGF2 domain, one in the linker region between the EGF2 domain and the AP domain, four in the AP domain, and four in the catalytic domain, including the C terminus, were identified as permissive sites by FIX activity assay (FIG. 1 and Table 7).

TABLE 7

Example FIX Insertion Sites

| Insertion Site | Domain | Activity AE42 | Activity AE72 | Activity AE144 | Activity AE288 | Activity AE4864 |
| --- | --- | --- | --- | --- | --- | --- |
| 52 | EGF1 | ND | | | | |
| 59 | EGF1 | ND | | | | |
| 66 | EGF1 | ND | | | | |
| 80 | EGF1 | ND | | | | |
| 85 | EGF2 | ND | | | | |

TABLE 7-continued

Example FIX Insertion Sites

| Insertion Site | Domain | Activity AE42 | Activity AE72 | Activity AE144 | Activity AE288 | Activity AE4864 |
|---|---|---|---|---|---|---|
| 89 | EGF2 | ND | | | | |
| 103 | EGF2 | + | ND | ND | ND | ND |
| 105 | EGF2 | + | ND | ND | ND | ND |
| 113 | EGF2 | ND | | | | |
| 129 | EGF2-AP Linker | ND | | | | |
| 142 | EGF2-AP Linker | ++ | ND | ND | ND | ND |
| 149 | AP | +++ | + | + | + | ND |
| 162 | AP | ++ | + | + | + | ND |
| 166 | AP | +++ | + | + | + | ND |
| 174 | AP | +++ | + | + | + | ND |
| 188 | Catalytic Domain | ND | | | | |
| 202 | Catalytic Domain | + | | | | |
| 224 | Catalytic Domain | + | + | ND | ND | ND |
| 226 | Catalytic Domain | + | | | | |
| 228 | Catalytic Domain | + | | | | |
| 230 | Catalytic Domain | ND | | | | |
| 240 | Catalytic Domain | ND | | | | |
| 257 | Catalytic Domain | + | | | | |
| 265 | Catalytic Domain | ND | | | | |
| 277 | Catalytic Domain | ND | | | | |
| 283 | Catalytic Domain | ND | | | | |
| 292 | Catalytic Domain | ND | | | | |
| 316 | Catalytic Domain | ND | | | | |
| 341 | Catalytic Domain | ND | | | | |
| 354 | Catalytic Domain | ND | | | | |
| 392 | Catalytic Domain | ND | | | | |
| 403 | Catalytic Domain | ND | | | | |
| 413 | Catalytic Domain | ++ | + | + | + | ND |
| 415 | C-Terminus | +++ | +++ | ++ | ++ | + |

Note:
ND = No activity detected; (+) = less than 30% activity detected; (++) = between 30% and 70% activity detected; and (+++) = greater than 70% activity detected as percent of base construct, by chromogenic assay (see Figures 5A-5C and 6A-6B).

Activity of Longer XTEN Insertions and C-Terminal Fusion

Longer XTENs (AE-72, -144 and -288) were then similarly tested at sites shown to be permissive for AE42 insertion. FIX activities were determined as previously described and are shown as percentage of the base construct without XTEN, FIX-R338L (FIG. 2).

Only sites in AP and sites at or close to the C-terminus of FIX tolerated longer XTENs (AE144, AE288 or AE864) (FIG. 2). FIX activity detected in conditioned medium inversely correlated with the length of XTEN introduced (FIG. 2, table 7). Four insertion permissive sites in different domains of FIX were selected to generate a combinatorial library.

Multiple XTEN Insertions

Based on results obtained with single XTEN variants, FIX variants with multiple XTEN insertions of varying lengths and at four different locations (see FIG. 4 and Table 8) were evaluated for FIX activity in conditioned medium of transfected HEK293 cells, by aPTT assay (Tables 8-10). FIX activities are shown as percentage of the base construct without XTEN, FIX-R338L (FIG. 4).

TABLE 8

Example FIX Double Insertions

| Insertion Site 1 | XTEN 1 (or Fc) | Insertion Site 2 | XTEN 2 (or Fc) | Activity |
|---|---|---|---|---|
| 105 | AE42 | | | ++ |
| 166 | AE42 | | | ++ |
| 166 | AE72 | | | + |
| 166 | AE144 | | | + |
| 224 | AE42 | | | + |
| C-Term | AE72 | | | ++ |
| C-Term | AE144 | | | + |
| C-Term | AE288 | | | + |
| C-Term | Fc | | | ++ |
| 166 | AE42 | C-Term | AE72 | ++ |
| 166 | AE42 | C-Term | AE144 | + |
| 166 | AE42 | C-Term | AE288 | + |
| 166 | AE72 | C-Term | AE72 | + |
| 166 | AE72 | C-Term | AE144 | + |
| 166 | AE72 | C-Term | AE288 | + |
| 166 | AE144 | C-Term | AE72 | + |
| 166 | AE144 | C-Term | AE144 | + |
| 166 | AE144 | C-Term | AE288 | + |
| 105 | AE42 | 166 | AE42 | + |
| 105 | AE42 | 166 | AE72 | + |
| 105 | AE42 | 166 | AE144 | ND |
| 105 | AE42 | C-Term | AE72 | + |
| 105 | AE42 | C-Term | AE144 | + |
| 105 | AE42 | C-Term | AE288 | + |
| 105 | AE42 | 224 | AE42 | + |
| 166 | AE42 | 224 | AE42 | + |
| 166 | AE72 | 224 | AE42 | + |
| 166 | AE144 | 224 | AE42 | ND |
| 224 | AE42 | C-Term | AE72 | + |
| 224 | AE42 | C-Term | AE144 | + |
| 224 | AE42 | C-Term | AE288 | + |
| 105 | AE42 | C-Term | Fc | + |
| 224 | AE42 | C-Term | Fc | + |
| 166 | AE42 | C-Term | Fc | + |
| 166 | AE72 | C-Term | Fc | + |
| 166 | AE144 | C-Term | Fc | + |

Note:
ND = No activity detected; (+) = less than 30% activity detected; (++) = between 30% and 70% activity detected; and (+++) = greater than 70% activity detected as percent of base construct, by chromogenic assay (see FIGS. 8A-8C).

TABLE 9

XTEN Elements Inserted into Each Domain

| Location | Element |
|---|---|
| EGF2 | AE42 |
| AP | AE42, AE72, AE144 |
| Catalytic 60-loop | AE42 |
| C-term | AE72, AE144, AE288, Fc |

TABLE 10

Total Number of Constructs Inserted as Single, Dual, Triple, and Quadruple Combinations

| Combination | # Constructs |
|---|---|
| Single | 9 |
| Dual | 27 |
| Triple | 31 |
| Quadruple | 12 |
| Total | 79 |

Three groups, FIX with a single XTEN, FIX with dual XTEN insertions and FIX-Fc with a single XTEN insertion, showed detectable activity, while combination of insertion/fusion at three or more sites abolished FIX activity (FIG. 4).

In conclusion, several permissive sites for XTEN insertion are present in FIX and select combinations of XTEN insertions variants retain FIX activity. Active FIX-XTEN variants identified here are candidates for pharmacokinetic characterization in hemophilia B mice.

Example 2: FIX Fusion Proteins and its Plasma Recovery and AUC/D

Figure 5:
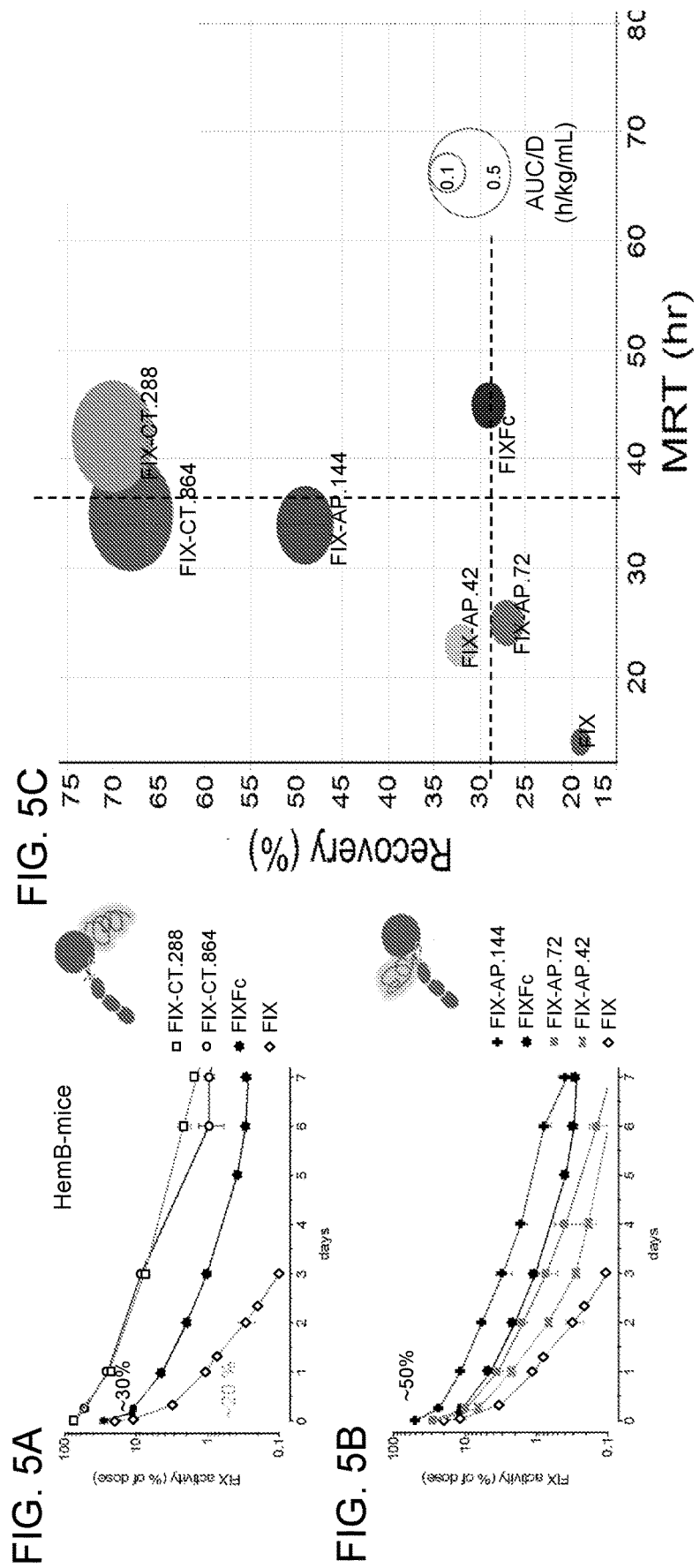
FIG. 5A provides a graph depicting the plasma percentile of dosed FIX clotting activities against time of various FIX fusion proteins with thrombin-cleavable C-terminal XTEN fusions of various length (e.g., FIX-CT.288 (XTEN of 288 amino acids, e.g., AE288) and FIX-CT.864 (XTEN of 864 amino acids, e.g., AE864)), compared to rFIX and rFIXFc as measured after single bolus intravenous dosing in hemophilia-B mice.
FIG. 5B provides a graph depicting the plasma percentile of dosed FIX clotting activities against time of various FIX fusion proteins with XTEN fusions of various length inserted into the activation peptide (AP) domain (e.g., FIX-AP.144, FIX-AP.72, and FIX-AP.42) compared to rFIX and rFIXFc, as measured after single bolus intravenous dosing in hemophilia-B mice.
FIG. 5C provides a graphical compilation of the calculated pharmacokinetic parameters of a single intravenous bolus dosed FIX fusion protein shown in FIGS. 5A and 5B. Indicated on the Y-axis is percentile of plasma activity recovery for each of the indicated molecules. The X-axis shows the calculated mean residence time (MRT, in hours), and the area of the dots represent the relative calculated area under the curve per dose (AUC/D, in h/kg/mL).
Figure 9:
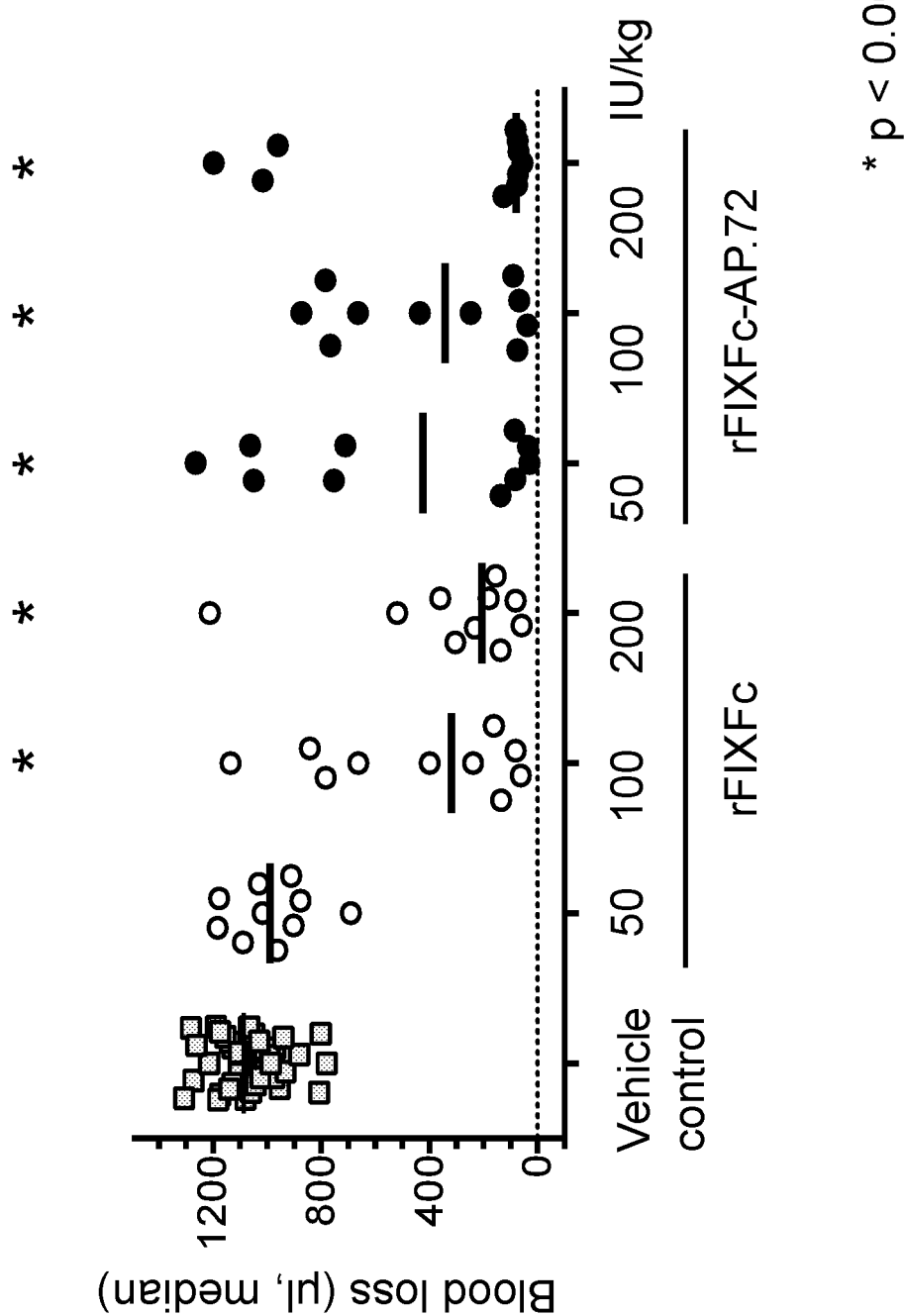
FIG. 9 is a graph showing the acute efficacy of rFIXFc-AP.72 compared to rFIXFc in the tail clip bleeding model. Results presented are individual and median blood loss (up at 5 minutes post dosing, over a 30 minutes period for treatments and dosing as indicated. Asterisks indicate significant p values for vehicle versus all other treatments. Data indicate similar or improved efficacy in mice dosed with rFIXFc-AP.72 compared to rFIXFc.

Factor IX deficient (HemB, B6.129P2-F9tm1Dws/J, MGI:1932297) mice (Lin. et al., 1997) were originally acquired from Dr. Darrel Stafford (University of North Carolina, Chapel Hill). Male/female HemB mice were each injected intravenously with a single intravenous bolus injection of 50 or 200 IU/kg of FIX fusion proteins (e.g., FIX-CT.288 (AE288 XTEN fused to the C-terminus of an FIX polypeptide), FIX-CT.864 (AE864 XTEN fused to the C-terminus of an FIX polypeptide), FIX-AP.144 (AE144 XTEN inserted after D166 within the AP domain of a FIX polypeptide), FIX-AP.72 (AE72 XTEN inserted after D166 within the AP domain of a FIX polypeptide), FIX-AP.42 (AE42 XTEN inserted after D166 within the AP domain of a FIX polypeptide), FIXFc, and FIX) at a dosing volume of 10 mL/kg at t=0 hour. Blood was collected at 5 minutes post dosing up to 168 hours (7 days) post dosing. For each indicated time point ~100 µl citrated blood was collected by retroorbital or terminal vena cava bleeding from 3-4 mice per time point. Up to 3 time points per mouse were generated. Plasma was isolated by centrifugation at 5000 rpm for 8 minutes and plasma samples were snap frozen in a dry-ice ethanol bath and stored at −80° C. until they were analyzed with one stage activated thromboplastin time (aPTT)-assay on a Sysmex-CA1500 coagulation analyzer, using Dade Behring reagents and actin FSL as activator and dosing material as activity standards. In FIGS. 5A-5B the plasma activities are plotted as % of injected dose. Mean Residence Time (MRT) and other pharmacokinetic (PK) parameters were calculated using non-compartmental modeling with Phoenix WinNonlin 6.2.1 (Pharsight, Certera by NCA analysis). Figure. 5C depicts the relative plasma recoveries (Y-axis) versus MRT (X-axis). The area of the dots represent the Area under the Curve per Dose (AUC/D, in h/kg/mL) and shows that FIX plasma activity recovery and AUC/D increase with increasing XTEN length (FIG. 5C). The figures show that the FIX fusion proteins with increased XTEN length (288 and 864 at the C-terminus or 144, 72, and 42 in the AP domain) exhibit a size-dependent increase in plasma recovery up to 60% and increased AUC/D following intravenous bolus dosing.

Example 3: FIX Fusion Proteins and their Half-Life

FIX deficient mice were intravenously dosed with 50 or 200 IU/kg of the FIX fusion proteins: FIX fused to an XTEN with 288 amino acids (e.g., AE288); FIX-Fc wherein an XTEN with 72 amino acids (e.g., AE72) is inserted at the AP domain after D166; FIX-Fc wherein an XTEN with 42 amino acids (e.g., AE42) is inserted at the AP domain after D166; and controls (e.g., FIXFc and FIX). Plasma was collected and FIX activity and PK analysis was performed identically to the methods described in Example 5. FIG. 6A plots the plasma activities as % of injected dose. Pharmacokinetic (PK) parameters were calculated using WinNonlin 6.2.1 (Pharsight, Certera by NCA analysis and FIG. 6B depicts the relative plasma recoveries (Y-axis) versus MRT (X-axis). The area of the dots represents the Area under the Curve per Dose (AUC/D, in h/kg/mL) and shows that insertion of XTEN sequences into the activation peptide (AP) domain of FIXFc extends the mean residence time longer than that of rFIXFc alone compared to FIX (FIG. 6B). In addition, plasma activity recovery and AUC/D are improved with increasing XTEN length (FIGS. 6A-6B). The AUC/D for rFIX-CT.288 (SEQ ID NO: 226) and rFIXFc-AP.72 (SEQ ID NO: 151) were 3.4 and 4.5-fold improved in comparison to rFIXFc, respectively (FIGS. 6A-6B). This is equivalent to a 8.5 and 14.5 fold improvement of AUC/D when compared to intravenously dosed rFIX, respectively (FIGS. 6A-6B). Therefore, combinations of XTEN insertions in the AP domain with Fc-mediated half-life extension in rFIXFc-R338L extend both the half-life and increase in the plasma recovery and AUC/Dose compared to that of rFIX and rFIXFc.

Example 4: Improved Pharmacokinetics of FIX Fusion Proteins by Subcutaneous Delivery FIX deficient mice were subcutaneously dosed at t=0 with 50 or 200 IU/kg of the FIX fusion proteins: FIX fused to an XTEN of 288 amino acids (e.g., AE288) at the C terminus (FIX-CT.288); FIXFc having an XTEN of 72 amino acids (e.g., AE72) in the AP domain (FIXFc-AP.72); FIXFc having an XTEN of 42 amino acids (e.g., AE42) in the EGF2 domain (e.g., FIXFc-EGF.42); and controls (FIXFc and FIX). Plasma was collected and FIX activity and PK analysis was performed identically to the methods described in Example 1. FIG. 7A plots the plasma activities as % of injected dose. Pharmacokinetic (PK) parameters were calculated using WinNonlin 6.2.1 (Pharsight, Certera by NCA analysis, and FIG. 7B depicts the relative bioavailability (Y-axis) versus MRT (X-axis). The area of the dots represents the Area under the Curve per Dose (AUC/D, in h/kg/mL) and shows that fusion of XTEN polypeptide sequences at the carboxy-terminus of rFIX or insertion of XTEN sequences into the activation peptide (AP) domain or EGF2 domain of FIXFc greatly improves the subcutaneous dosing profile of the FIX fusion proteins (FIG. 7B). rFIXFc-AP.72 and rFIX-CT.288 have a 6 to 9-fold improved AUC/D, 1.5 to 2 fold improved bioavailability and 3 to 10 fold improved $C_{max}$/D for, compared to rFIXFc in HemB mice for subcutaneous dosing. When compared to rFIX the improvement in pharmacokinetic parameters is 28 to 40-fold improved AUC/D, 3-fold increased bioavailability and 15 to 30-fold improved $C_{max}$/D compared to rFIX for FIXFc-AP.72 and rFIX-CT.288, respectively (FIGS. 7A-7B).

Taken together, the FIX fusion proteins (e.g., rFIX-CT.288 and rFIXFc-AP.72) showed a 2.6- and 1.9-fold improved AUC/D for subcutaneous dosing when compared to intravenous dosing of rFIXFc, the latter supporting once weekly or less frequent intravenous dosing in humans for prophylaxis.

Example 5: In Vitro Efficacy of FIX Fusion Proteins

Human hemophilia-B blood was spiked with the indicated doses of 3 10, and 30 IU/dL of rFIXFc (open circles, dotted line) or a FIX fusion protein (e.g., rFIXFc-AP.72) (solid dots, solid line) or vehicle (open triangle) (FIGS. 8A-8C). Whole blood clotting characteristics were determined using rotational thromboelastometry (ROTEM) and coagulation was initiated by recalcification of the blood (NATEM). rFIXFc-AP.72 showed similar activity compared to rFIXFc in hemophila-B blood, in respect to clotting time (CT in seconds), alpha angle (in degrees) and maximum clot firmness (MCF in mm) (FIGS. 8A-8C). The data each time point is the average+/−standard deviation of 4 to 5 replicate samples (FIGS. 8A-8C).

rFIXFc-AP.72 and rFIX-CT.288 show greatly improved subcutaneous pharmacokinetics in HemB mice compared to both rFIX and rFIXFc. Further studies are ongoing to address the efficacy and allometric scaling in preclinical animal models.

Example 6: In Vivo Efficacy of rFIXFc-AP.72 in an Acute Murine Tail Clip Bleeding Model Acute efficacy was studied in a blinded murine tail-clip bleeding model, in which total blood loss in dosed mice is measured after tail tip amputation, as described previously (Dumont et al., Blood, 119(13):3024-3030, 2012). Briefly, 8-15 weeks old male Hemophilia B mice (Lin et al., Blood (1997) 90: 3962-3966) were anesthetized with a cocktail of 50 mg/kg ketamine and 0.5 mg/kg dexmedetomidine. The tails were immersed in 37° C. saline for 10 minutes, to dilate the lateral vein followed by intravenous tail vein injection of either vehicle (3.88 g/L L-Histidine, 23.8 g/L Mannitol, 11.9 g/L Sucrose, 3.25 g/L Sodium Chloride, 0.01% (w/v) Polysorbate 20 (pH 7.1), 3% human serum albumin), rFIXFc-AP.72, or rFIXFc at 50, 100, and 200 IU/kg. Five minutes post-dosing, the 5 mm distal tip of the tail was clipped and submerged into a pre-weighted tube containing 13 mL saline for the period of 30 minutes. Blood loss was quantified by weight. Statistical significance was calculated using unpaired two-tailed t-test in GraphPad Prism 6. Such two tailed t-tests showed that the 50, 100, and 200 IU/kg doses of rFIXFc-AP.72 were significantly different from vehicle (p-value<0.0001). In addition, the data show that a low dose, e.g., 50 IU/kg, of rFIXFc-AP.72 results in significantly lower blood loss compared to the same low dose, i.e., 50 IU/kg, of rFIXFc. These results demonstrate equal or improved acute efficacy for rFIXFc-AP.72 compared to rFIXFc in this bleeding model.

Example 7: In Vivo Efficacy of FIXFc-AP.72 in a Prophylactic Murine Tail Vein Transection Bleeding Model Prolonged efficacy was studied in a blinded murine tail vein transection (TVT) bleeding model, in which survival time of dosed hemophilia-B mice is measured after transection of one lateral tail vein, as described previously (Toby et al., PLOS One, DOI:10.1371/journal.pone.0148255, 2016; Pan et al., Blood 114:2802-2822 (2009)). Briefly, 8-15 weeks old male hemophilia B mice (Lin et al., Blood 90: 3962-3966 (1997)) were pre-dosed intravenously with 15, 50, 100 IU/kg FIX activity of rFIXFc or matching subcutaneous doses of FIXFc-AP.72 and compared to mice receiving a bolus dose of vehicle. At 72 hours post dosing, all mice were anesthetized and one lateral tail vein was transected at a 2.7 mm tail diameter. During the 9 to 11 hours immediately following the TVT and then at an overnight time point at 24 hours, qualitative end points were monitored and recorded hourly, including rebleeding and time to death (as defined as the time to euthanization, as determined when the animal was moribund). All mice were euthanized at the end of 24 hour study, while animals not dead or moribund were determined to have survived at 24 hours.

Figure 10:
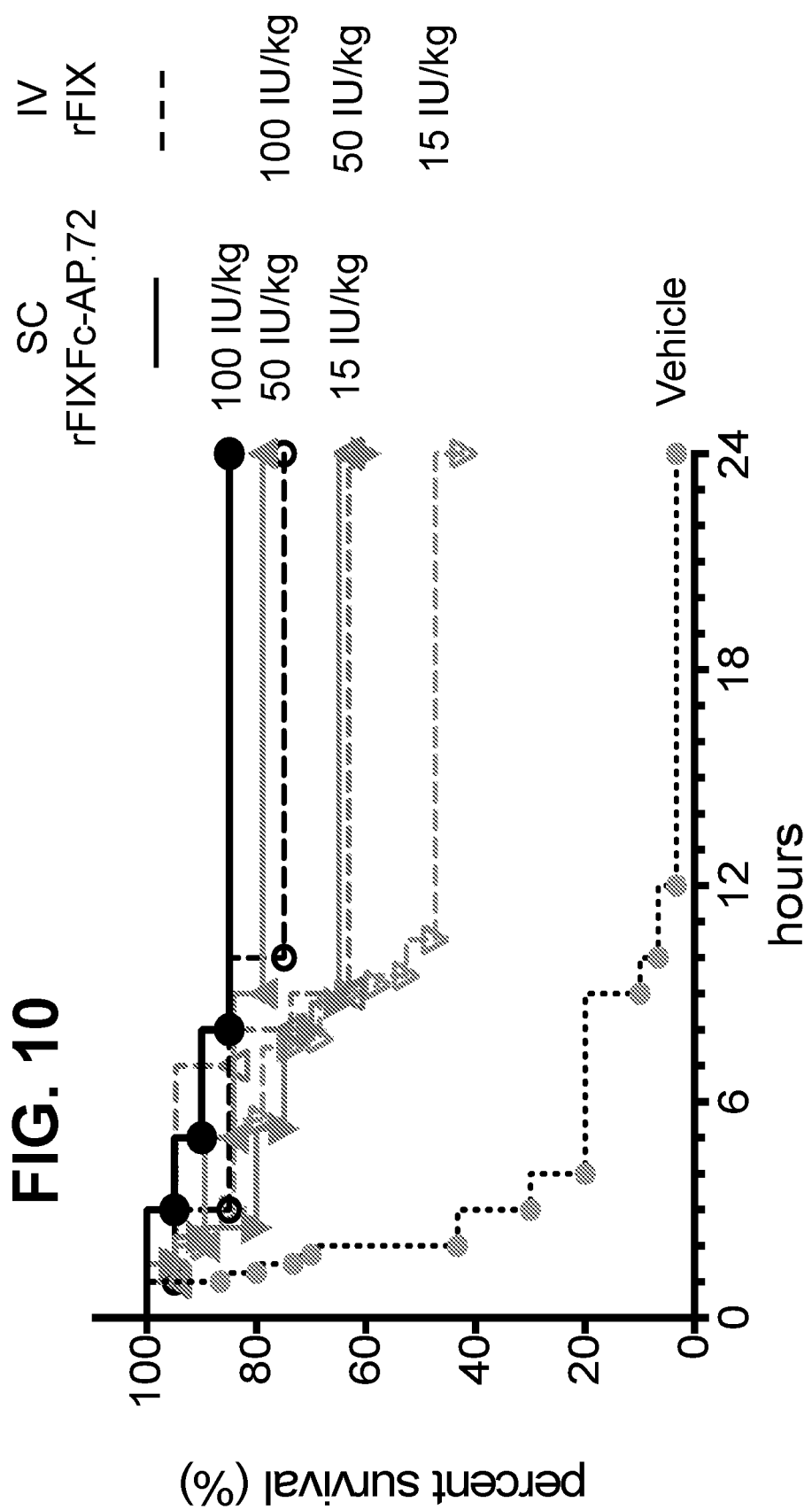
FIG. 10 is a graph showing the percentage of HemB mice surviving (Y-axis) plotted against the time in hours post tail vein transection (X-axis). All mice were pre-dosed 72 hours prior to the tail vein transection intravenously with FIXFc (dotted lines) or subcutaneously with FIXFc-AP.72 at the indicated IU/kg (FIXFc-AP.72: 100 IU/kg (solid black circle), 50 IU/kg (solid grey triangle), and 15 IU/kg (solid inverted grey triangle); rFIXFc: 100 IU/kg (open circle), 50 IU/kg (open triangle), and 15 IU/kg (open inverted triangle); and vehicle (closed grey circle). Survival plots for mice dosed with either rFIXFc or FIXFc-AP.72 are all significantly different when compared to vehicle treated mice (p<0.0001, Log-rank (Mantel-Cox) test.

Data were plotted as percent survival following TVT using GraphPad Prism 6. Mice dosed subcutaneously with vehicle (dotted line), subcutaneously with FIXFc-AP.72 (solid lines, closed symbols) or intravenously dosed with FIXFc (dashed lines, open symbols) (15 IU/kg, 50 IU/kg, 100 IU/kg n=20/dose except for vehicle dose; n=30) (FIG. 10). The survival curves for mice treated with matching IU/kg doses of subcutaneously dosed FIXFc-AP.72 versus intravenously dosed rFIXFc showed improved survival of HemB mice dosed subcutaneously with FIXFc-AP.72 compared to the equivalent intravenously dosed rFIXFc at all doses tested (FIG. 10).

Figure 11A:
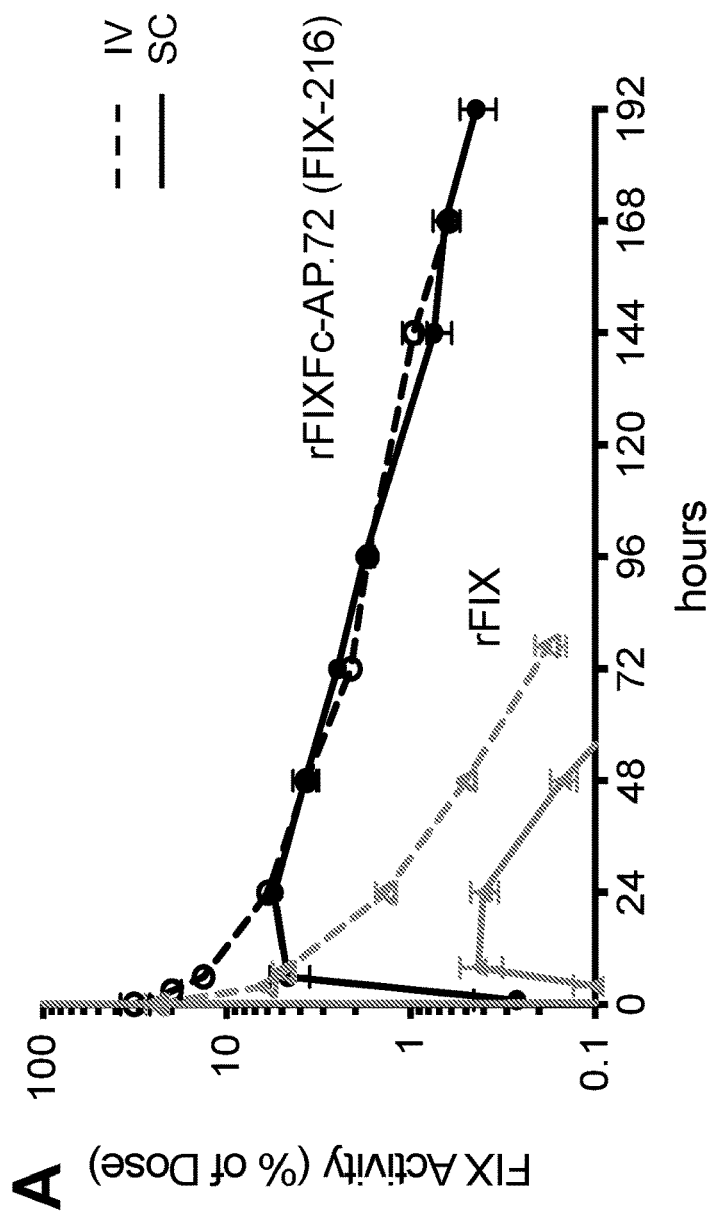
FIG. 11A is a graph showing the plasma levels of FX activity as measured by a one-stage plasma assay plotted versus time for Hemophilia B mice which were dosed by either intravenous (dashed lines) or subcutaneous injection (solid lines) with a single bolus (200 IU/kg) of rFIX (grey) or the rFIXFc-AP.72 fusion protein (black).
Figure 11B:
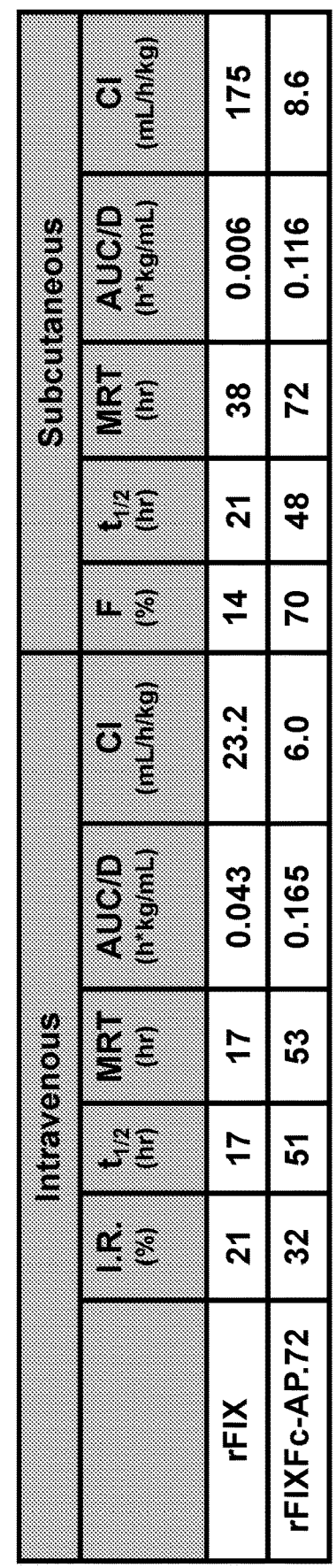
FIG. 11B shows pharmacokinetic parameters as determined using non-compartmental analysis (NCA) using Phoenix WinNonLin 6.2.1 software (Pharsight, Certara).
Figure 12A:
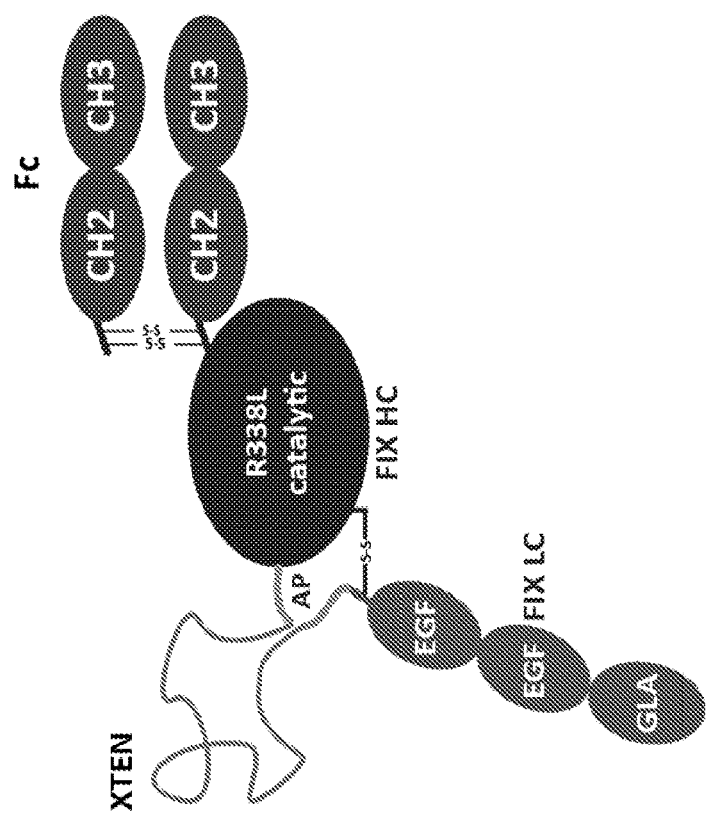
FIG. 12A is a schematic drawing illustrating the domain structure of rFIXFc-AP.72 single chain Fc.
Figure 12B:
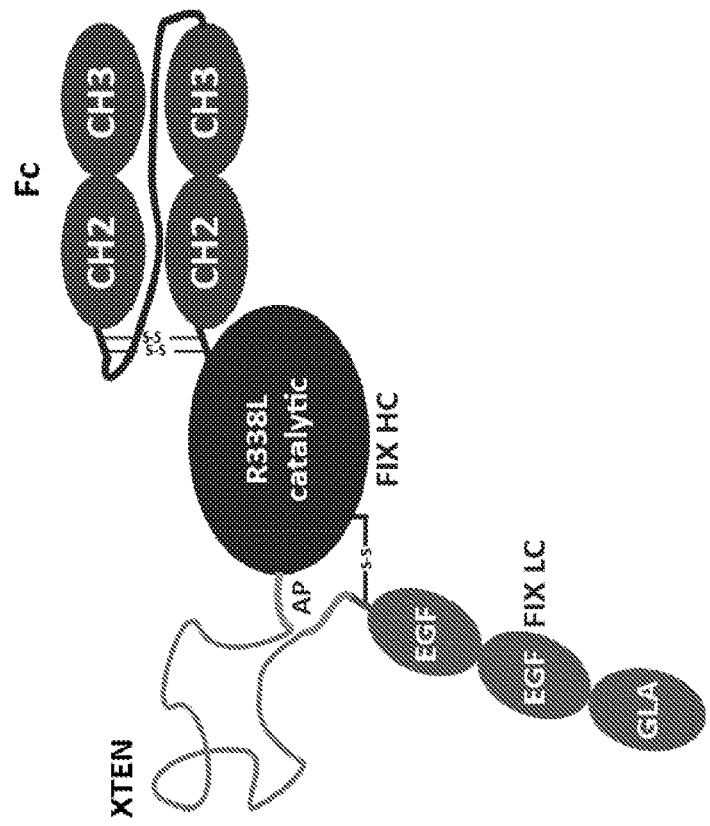
FIG. 12B is a schematic drawing showing the domain structure of rFIXFc-AP.72 dual chain Fc. "FIX HC" refers to the heavy chain of FIX; "FIX LC" refers to the light chain of FIX, which includes the EGF and GLA domains of FIX; and AP refers to the activation peptide of FIX.

Example 8: Improved Intravenous and Subcutaneous Pharmacokinetic Parameters for FIXFc-AP.72 (FIX-216, Dual Chain Fc) Compared to rFIX in Hemb Mice Hemophilia-B mice were dosed with either 200 IU/kg FIXFc-AP.72 (FIX-216, dual chain Fc) or rFIX. Blood was collected by retro-orbital bleeding at the indicated times. Plasma levels of FIX were determined by one-stage clotting assay activity using dosing material as activity standards. In FIG. 11A plasma activity is plotted as % of injected dose. FIG. 11B shows a table of the pharmacokinetic parameters calculated using Phoenix WinNonLin 6.2.1 (Pharsight, Certara) by NCA (non-compartmental) analysis. Improved pharmacokinetic parameters shown for FIX-216 versus rFIX include the Mean Residence Time (MRT), the AUC/dose and other parameters.

Subcutaneous dosing of FIXFc-AP.72 shows a $t_{max}$ around 20 hours post dosing in mice, and improved plasma activity levels compared to similar (IU/kg) intravenously dosed rFIX or rFIXFc. Using the TVT bleeding model in HemB mice we show that at 72 hours post dosing, subcutaneously dosed FIXFc-AP.72 has improved in vivo efficacy compared to intravenously dosed rFIXFc at all tested doses. Similarly, acute efficacy testing in the HemB mouse tail-clip bleeding model showed improved efficacy of intravenously dosed FIXFc-AP.72 compared to rFIXFc. These data support the potential of once weekly or less frequent subcutaneous prophylactic dosing of FIXFc-AP.72 in humans.

The foregoing description of the specific embodiments will so fully reveal the general nature of the invention that others can, by applying knowledge within the skill of the art, readily modify and/or adapt for various applications such specific embodiments, without undue experimentation, without departing from the general concept of the present invention. Therefore, such adaptations and modifications are intended to be within the meaning and range of equivalents of the disclosed embodiments, based on the teaching and guidance presented herein. It is to be understood that the phraseology or terminology herein is for the purpose of description and not of limitation, such that the terminology or phraseology of the present specification is to be interpreted by the skilled artisan in light of the teachings and guidance.

Other embodiments of the invention will be apparent to those skilled in the art from consideration of the specification and practice of the invention disclosed herein. It is intended that the specification and examples be considered as exemplary only, with a true scope and spirit of the invention being indicated by the following claims.

The present application claims benefit to U.S. Provisional Application Nos. 62/200,590 filed Aug. 3, 2015 and 62/281,993 filed Jan. 22, 2016, which are incorporated herein by reference in their entirety.

Embodiments

E1. A Factor IX (FIX) fusion protein comprising a FIX polypeptide and at least one XTEN which is inserted within the FIX polypeptide at an insertion site corresponding to an amino acid selected from the group consisting of amino acid 103 of SEQ ID NO: 2, amino acid 105 of SEQ ID NO: 2, amino acid 142 of SEQ ID NO: 2, amino acid 149 of SEQ ID NO: 2, amino acid 162 of SEQ ID NO: 2, amino acid 166 of SEQ ID NO: 2, amino acid 174 of SEQ ID NO: 2, amino acid 224 of SEQ ID NO: 2, amino acid 226 of SEQ ID NO: 2, amino acid 228 of SEQ ID NO: 2, amino acid 413 of SEQ ID NO: 2, and any combination thereof, and wherein the FIX fusion protein exhibits procoagulant activity.

E2. The FIX fusion protein of E1, wherein the insertion site corresponds to an amino acid selected from the group consisting of amino acid 149 of SEQ ID NO: 2, amino acid 162 of SEQ ID NO: 2, amino acid 166 of SEQ ID NO: 2, amino acid 174 of SEQ ID NO: 2 and any combination thereof.

E3. The FIX fusion protein of E1 or E2, wherein the insertion site corresponds to an amino acid selected from the group consisting of amino acid 224 of SEQ ID NO: 2, amino acids 226 of SEQ ID NO: 2, amino acids 228 of SEQ ID NO: 2; amino acid 413 of SEQ ID NO: 2, and any combination thereof.

E4. The FIX fusion protein of any one of E1 to E3, wherein the insertion site corresponds to an amino acid selected from the group consisting of amino acid 103 of SEQ ID NO: 2, amino acid 105 of SEQ ID NO: 2, and both.

E5. The FIX fusion protein of any one of E1 to E4, wherein the insertion site corresponds to amino acid 142 of SEQ ID NO: 2.

E6. The FIX fusion protein of any one of E1 to E5, wherein the XTEN comprises at least about 6 amino acids, at least about 12 amino acids, at least about 36 amino acids, at least about 42 amino acids, at least about 72 amino acids, at least about 144 amino acids, or at least about 288 amino acids.

E7. The FIX fusion protein of any one of E1 to E6, wherein the XTEN comprises AE42, AE72, AE864, AE576, AE288, AE144, AG864, AG576, AG288, AG144, or any combination thereof.

E8. The FIX fusion protein of any one of E1 to E7, wherein the XTEN comprises an amino acid sequence at least about 80%, at least about 85%, at least about 90%, at least about 95%, at least about 96%, at least about 97%, at least about 98%, at least about 99%, or about 100% identical to an amino acid sequence selected from the group consisting of SEQ ID NOs: 34, 35, 36, 37, 38, 39, 40, 41, 42, 43, 44, 45, 46, 47, 48, 49, 50, 51, 52, 53, and any combination thereof.

E9. The FIX fusion protein of E7 or E8, wherein the XTEN comprises AE72 or AE144.

E10. The FIX fusion protein of any one of E1 to E9, which further comprises a second XTEN.

E11. The FIX fusion protein of E10, wherein the second XTEN is inserted within the FIX polypeptide at an insertion site corresponding to an amino acid selected from the group consisting of amino acid 103 of SEQ ID NO: 2, amino acid 105 of SEQ ID NO: 2, amino acid 142 of SEQ ID NO: 2, amino acid 149 of SEQ ID NO: 2, amino acid 162 of SEQ ID NO: 2, amino acid 166 of SEQ ID NO: 2, amino acid 174 of SEQ ID NO: 2, amino acid 224 of SEQ ID NO: 2, amino acid 226 of SEQ ID NO: 2, amino acid 228 of SEQ ID NO: 2, amino acid 413 of SEQ ID NO: 2, and any combination thereof or wherein the second XTEN is fused to either the C-terminus of the FIX polypeptide or a linker fused to the C-terminus of the FIX polypeptide.

E12. The FIX fusion protein of E10 or E11, wherein the XTEN and the second XTEN are inserted within the FIX polypeptide at an insertion site corresponding to an amino acid and/or fused to the C-terminus of the FIX polypeptide selected from the group consisting of:
  i. amino acid 105 of SEQ ID NO: 2 and amino acid 166 of SEQ ID NO: 2;
  ii. amino acid 105 of SEQ ID NO: 2 and amino acid 224 of SEQ ID NO: 2;
  iii. amino acid 105 of SEQ ID NO: 2 and fused to the C-terminus;
  iv. amino acid 166 of SEQ ID NO: 2 and amino acid 224 of SEQ ID NO: 2;
  v. amino acid 166 of SEQ ID NO: 2 and fused to the C-terminus; and
  vi. amino acid 224 of SEQ ID NO: 2 and fused to the C-terminus, respectively.

E13. The FIX fusion protein of E10 or E11, wherein the XTEN is inserted within the FIX polypeptide at an insertion site corresponding to amino acid 166 of SEQ ID NO: 2, and wherein the second XTEN is fused to the C-terminus of the FIX polypeptide.

E14. The FIX fusion protein of any one of E10 to E13, wherein the second XTEN comprises at least about 6 amino acids, at least about 12 amino acids, at least about 36 amino acids, at least about 42 amino acids, at least about 72 amino acids, at least about 144 amino acids, or at least about 288 amino acids.

E15. The FIX fusion protein of any one of E10 to E14, wherein the second XTEN is selected from the group consisting of AE42, AE72, AE864, AE576, AE288, AE144, AG864, AG576, AG288, AG144, and any combination thereof.

E16. The FIX fusion protein of E15, wherein the second XTEN is AE72 or AE144.

E17. The FIX fusion protein of any one of E10 to E16, wherein the second XTEN comprises an amino acid sequence at least about 80%, at least about 85%, at least about 90%, at least about 95%, at least about 96%, at least about 97%, at least about 98%, at least about 99%, or about 100% identical to an amino acid sequence selected from the group consisting of SEQ ID NOs: 34, 35, 36, 37, 38, 39, 40, 41, 42, 43, 44, 45, 46, 47, 48, 49, 50, 51, 52, 53, and any combination thereof.

E18. The FIX fusion protein of any one of E10 to E17, which further comprises a third, a fourth, a fifth, or a sixth XTEN.

E19. A FIX fusion protein comprising a FIX polypeptide and a heterologous moiety comprising an XTEN, wherein the XTEN is fused to the C-terminus of the FIX polypeptide and comprises an amino acid sequence of longer than 42 amino acids and shorter than 144 amino acids in length.

E20. The FIX fusion protein of E19, wherein the XTEN comprises an amino acid sequence of longer than 50, 55, 60, 65, or 70 amino acids and shorter than 140, 130, 120, 110, 100, 90, or 80 amino acids or any combination thereof.

E21. The FIX fusion protein of E20, wherein the XTEN is 72 amino acids in length.

E22. The FIX fusion protein of E21, wherein the XTEN is AE72.

E23. The FIX fusion protein of E19, wherein the XTEN comprises an amino acid sequence at least about 80%, at least about 85%, at least about 90%, at least about 95%, at least about 96%, at least about 97%, at least about 98%, at least about 99%, or 100% identical to SEQ ID NO: 35.

E24. The FIX fusion protein of any one of E1 to E23, further comprising an Fc domain.

E25. The FIX fusion protein of E24, wherein the Fc domain is fused to the FIX polypeptide or the XTEN.

E26. The FIX fusion protein of E24 or E25, comprising a second Fc domain.

E27. The FIX fusion protein of E26, wherein the second Fc domain is associated with the first Fc domain.

E28. The FIX fusion protein of E26 or E27, which comprises two polypeptide chains, wherein the first polypeptide chain comprises the FIX polypeptide fused to the Fc domain, and the second polypeptide chain comprises the second Fc domain, wherein the first Fc domain and the second Fc domain are associated by a covalent bond.

E29. The FIX fusion protein of E26 or E27, which is a single polypeptide chain comprising the FIX polypeptide, the Fc domain, the second Fc domain, and a linker which links the Fc domain and the second Fc domain.

E30. The FIX fusion protein of E29, wherein the linker further comprises one or more intracellular processing sites.

E31. The FIX fusion protein of E29 or E30, wherein the linker comprises (Gly$_4$Ser)$_n$, wherein n is an integer selected from 1 to 100.

E32. The FIX fusion protein of E1 to E31, comprising an amino acid sequence at least about 80%, at least about 85%, at least about 90%, at least about 95%, at least about 96%, at least about 97%, at least about 98%, at least about 99%, or about 100% identical to a sequence selected from the group consisting of SEQ ID NO: 54 to SEQ ID NO: 153 without the signal peptide and the propeptide sequence.

E33. The FIX fusion protein of any one of E1 to E32, which has at least about 10%, at least about 20%, at least about 30%, at least about 40%, at least about 50%, at least about 60%, at least about 70%, at least about 80%, at least about 90% or 100% of the procoagulant activity of native FIX.

E34. The FIX fusion protein of E33, wherein the procoagulant activity is measured by a chromogenic substrate assay, a one stage clotting assay, or both.

E35. The FIX fusion protein of any one of E1 to E34, wherein the FIX polypeptide is a R338L FIX variant.

E36. The FIX fusion protein of E35, wherein the R338L FIX variant comprises an amino acid sequence at least about 80%, at least about 85%, at least about 90%, at least about 95%, at least about 96%, at least about 97%, at least about 98%, at least about 99%, or 100% identical to SEQ ID NO: 2.

E37. An isolated polynucleotide comprising a sequence encoding the FIX fusion protein of any one of E1 to E36.

E38. An expression vector comprising the polynucleotide of E37.

E39. A host cell comprising the polynucleotide of E37 or the vector of E38.

E40. The host cell of E39, wherein the FIX fusion protein is expressed in vivo.

E41. The host cell of E39, wherein the FIX fusion protein is expressed in vitro.

E42. A method of producing a FIX fusion protein comprising culturing the host cell of E39 under conditions in which the FIX fusion protein is expressed.

E43. A composition comprising the FIX fusion protein of any one of E1 to E36, the polynucleotide of E37, the expression vector of E38, or the host cell of any one of E39 to E41 and a pharmaceutically acceptable carrier.

E44. A method of preventing, treating, ameliorating, or managing a clotting disease or condition in a patient in need thereof comprising administering an effective amount of the FIX fusion protein of any one of E1 to E36, the polynucleotide of E37, the expression vector of E38, the host cell of any one of E39 to E41, or the composition of E43.

E45. The method of E44, wherein the administering comprises subcutaneous administration to the patient.

E46. A method for diagnosing or imaging a clotting disease or condition in a subject comprising contacting the FIX fusion protein of any one of E1 to E36, the polynucleotide of E37, the expression vector of E38, or the host cell of any one of E39 to E41 with a sample of the subject.

E47. A method of extending a half-life of a FIX polypeptide comprising inserting an XTEN within the FIX polypeptide at an insertion site corresponding to an amino acid selected from the group consisting of amino acid 103 of SEQ ID NO: 2, amino acid 105 of SEQ ID NO: 2, amino acid 142 of SEQ ID NO: 2, amino acid 149 of SEQ ID NO: 2, amino acid 162 of SEQ ID NO: 2, amino acid 166 of SEQ ID NO: 2, amino acid 174 of SEQ ID NO: 2, amino acid 224 of SEQ ID NO: 2, amino acid 226 of SEQ ID NO: 2, amino acid 228 of SEQ ID NO: 2, amino acid 413 of SEQ ID NO: 2, and any combination thereof, thereby constructing a FIX fusion protein, wherein the FIX protein exhibits procoagulant activity.

E48. A Factor IX (FIX) fusion protein comprising a first chain and a second chain, wherein:
a. the first chain comprises:
  i. a FIX polypeptide;
  ii. at least one XTEN, wherein the at least one XTEN is inserted within the FIX polypeptide at an insertion site corresponding to amino acid 166 of SEQ ID NO: 2, and wherein the at least one XTEN comprises an amino acid sequence having at least about 72 amino acids; and
  iii. a first Fc domain, wherein the first Fc domain is fused to the FIX polypeptide of the at least one XTEN; and
b. the second chain comprises a second Fc domain
wherein the first Fc domain and the second Fc domain are associated by a covalent bond; and wherein the FIX fusion protein exhibits procoagulant activity.

E49. The FIX fusion protein of E48, wherein the at least one XTEN comprises an amino acid sequence at least about 80%, at least about 85%, at least about 90%, at least about 95%, at least about 96%, at least about 97%, at least about 98%, at least about 99%, or about 100% identical to the amino acid sequence of SEQ ID NO: 35.

E50. The FIX fusion protein of E48 or E49, wherein the first chain of the FIX fusion protein comprises an amino acid sequence at least about 80%, at least about 85%, at least about 90%, at least about 95%, at least about 96%, at least about 97%, at least about 98%, or at least about 99% identical to the amino acid sequence of SEQ ID NO: 227; and wherein the second chain of the FIX fusion protein comprises an amino acid sequence at least about 80%, at least about 85%, at least about 90%, at least about 95%, at least about 96%, at least about 97%, at least about 98%, or at least about 99% identical to the amino acid sequence of SEQ ID NO: 228.

E51. The FIX fusion protein of any one of E48 to E50, wherein the first chain of the FIX fusion protein comprises an amino acid sequence of SEQ ID NO: 227; and wherein the second chain of the FIX fusion protein comprises an amino acid sequence of SEQ ID NO: 228.

The following vector sequences are referenced in the proceeding examples and elsewhere in the present application. The following key will aid in understanding the information:

SEQ ID NO: 54 E0113 AE42; PNL118
MQRVNMIMAESPGLITICLLGYLLSAECTVFLDHENANKILNRPKRYNSGKLEEFVQGNLER
ECMEEKCSFEEAREVFENTERTTEFWKQYVDGDQCESNPCLNGGSCKDDINSYECWCPFGFE
GKNCELDVTCNIKNGRCEQFCKNSADNKVVCSCTEGAPGSPAGSPTSTEEGTSESATPESGP
GSEPATSGSETPASSGYRLAENQKSCEPAVPFPCGRVSVSQTSKLTRAETVFPDVDYVNSTE
AETILDNITQSTQSFNDFTRVVGGEDAKPGQFPWQVVLNGKVDAFCGGSIVNEKWIVTAAHC
VETGVKITVVAGEHNIEETEHTEQKRNVIRIIPHHNYNAAINKYNHDIALLELDEPLVLNSY
VTPICIADKEYTNIFLKFGSGYVSGWGRVFHKGRSALVLQYLRVPLVDRATCLLSTKFTIYN
NMFCAGFHEGGRDSCQGDSGGPHVTEVEGTSFLTGIISWGEECAMKGKYGIYTKVSRYVNWI
KEKTKLTGPEGPSKLTRAETGAGSPGAETAEQKLISEEDLSPATGHHHHHHHH

SEQ ID NO: 55 N0089 AE42 pNL116
MQRVNMIMAESPGLITICLLGYLLSAECTVFLDHENANKILNRPKRYNSGKLEEFVQGNLER
ECMEEKCSFEEAREVFENTERTTEFWKQYVDGDQCESNPCLNGGSCKDDINSYECWCPFGFE
GKNCELDVTCNGAPGSPAGSPTSTEEGTSESATPESGPGSEPATSGSETPASSIKNGRCEQF
CKNSADNKVVCSCTEGYRLAENQKSCEPAVPFPCGRVSVSQTSKLTRAETVFPDVDYVNSTE
AETILDNITQSTQSFNDFTRVVGGEDAKPGQFPWQVVLNGKVDAFCGGSIVNEKWIVTAAHC
VETGVKITVVAGEHNIEETEHTEQKRNVIRIIPHHNYNAAINKYNHDIALLELDEPLVLNSY
VTPICIADKEYTNIFLKFGSGYVSGWGRVFHKGRSALVLQYLRVPLVDRATCLLSTKFTIYN
NMFCAGFHEGGRDSCQGDSGGPHVTEVEGTSFLTGIISWGEECAMKGKYGIYTKVSRYVNWI
KEKTKLTGPEGPSKLTRAETGAGSPGAETAEQKLISEEDLSPATGHHHHHHHH

SEQ ID NO: 56 A0103 AE42 pNL117
MQRVNMIMAESPGLITICLLGYLLSAECTVFLDHENANKILNRPKRYNSGKLEEFVQGNLER
ECMEEKCSFEEAREVFENTERTTEFWKQYVDGDQCESNPCLNGGSCKDDINSYECWCPFGFE
GKNCELDVTCNIKNGRCEQFCKNSAGAPGSPAGSPTSTEEGTSESATPESGPGSEPATSGSE
TPASSDNKVVCSCTEGYRLAENQKSCEPAVPFPCGRVSVSQTSKLTRAETVFPDVDYVNSTE
AETILDNITQSTQSFNDFTRVVGGEDAKPGQFPWQVVLNGKVDAFCGGSIVNEKWIVTAAHC
VETGVKITVVAGEHNIEETEHTEQKRNVIRIIPHHNYNAAINKYNHDIALLELDEPLVLNSY
VTPICIADKEYTNIFLKFGSGYVSGWGRVFHKGRSALVLQYLRVPLVDRATCLLSTKFTIYN
NMFCAGFHEGGRDSCQGDSGGPHVTEVEGTSFLTGIISWGEECAMKGKYGIYTKVSRYVNWI
KEKTKLTGPEGPSKLTRAETGAGSPGAETAEQKLISEEDLSPATGHHHHHHHH

SEQ ID NO: 57 P0129 AE42 pNL119
MQRVNMIMAESPGLITICLLGYLLSAECTVFLDHENANKILNRPKRYNSGKLEEFVQGNLER
ECMEEKCSFEEAREVFENTERTTEFWKQYVDGDQCESNPCLNGGSCKDDINSYECWCPFGFE
GKNCELDVTCNIKNGRCEQFCKNSADNKVVCSCTEGYRLAENQKSCEPAVPGAPGSPAGSPT
STEEGTSESATPESGPGSEPATSGSETPASSFPCGRVSVSQTSKLTRAETVFPDVDYVNSTE
AETILDNITQSTQSFNDFTRVVGGEDAKPGQFPWQVVLNGKVDAFCGGSIVNEKWIVTAAHC
VETGVKITVVAGEHNIEETEHTEQKRNVIRIIPHHNYNAAINKYNHDIALLELDEPLVLNSY
VTPICIADKEYTNIFLKFGSGYVSGWGRVFHKGRSALVLQYLRVPLVDRATCLLSTKFTIYN
NMFCAGFHEGGRDSCQGDSGGPHVTEVEGTSFLTGIISWGEECAMKGKYGIYTKVSRYVNWI
KEKTKLTGPEGPSKLTRAETGAGSPGAETAEQKLISEEDLSPATGHHHHHHHH

SEQ ID NO: 58 K0142 AE42 pNL120
MQRVNMIMAESPGLITICLLGYLLSAECTVFLDHENANKILNRPKRYNSGKLEEFVQGNLER
ECMEEKCSFEEAREVFENTERTTEFWKQYVDGDQCESNPCLNGGSCKDDINSYECWCPFGFE
GKNCELDVTCNIKNGRCEQFCKNSADNKVVCSCTEGYRLAENQKSCEPAVPFPCGRVSVSQT
SKGAPGSPAGSPTSTEEGTSESATPESGPGSEPATSGSETPASSLTRAETVFPDVDYVNSTE
AETILDNITQSTQSFNDFTRVVGGEDAKPGQFPWQVVLNGKVDAFCGGSIVNEKWIVTAAHC
VETGVKITVVAGEHNIEETEHTEQKRNVIRIIPHHNYNAAINKYNHDIALLELDEPLVLNSY
VTPICIADKEYTNIFLKFGSGYVSGWGRVFHKGRSALVLQYLRVPLVDRATCLLSTKFTIYN
NMFCAGFHEGGRDSCQGDSGGPHVTEVEGTSFLTGIISWGEECAMKGKYGIYTKVSRYVNWI
KEKTKLTGPEGPSKLTRAETGAGSPGAETAEQKLISEEDLSPATGHHHHHHHH

SEQ ID NO: 59 V0149_AE42 pNL121
MQRVNMIMAESPGLITICLLGYLLSAECTVFLDHENANKILNRPKRYNSGKLEEFVQGNLER
ECMEEKCSFEEAREVFENTERTTEFWKQYVDGDQCESNPCLNGGSCKDDINSYECWCPFGFE
GKNCELDVTCNIKNGRCEQFCKNSADNKVVCSCTEGYRLAENQKSCEPAVPFPCGRVSVSQT
SKLTRAETVGAPGSPAGSPTSTEEGTSESATPESGPGSEPATSGSETPASSFPDVDYVNSTE
AETILDNITQSTQSFNDFTRVVGGEDAKPGQFPWQVVLNGKVDAFCGGSIVNEKWIVTAAHC
VETGVKITVVAGEHNIEETEHTEQKRNVIRIIPHHNYNAAINKYNHDIALLELDEPLVLNSY
VTPICIADKEYTNIFLKFGSGYVSGWGRVFHKGRSALVLQYLRVPLVDRATCLLSTKFTIYN
NMFCAGFHEGGRDSCQGDSGGPHVTEVEGTSFLTGIISWGEECAMKGKYGIYTKVSRYVNWI
KEKTKLTGPEGPSKLTRAETGAGSPGAETAEQKLISEEDLSPATGHHHHHHHH

SEQ ID NO: 60 E0162_AE42 pNL122
MQRVNMIMAESPGLITICLLGYLLSAECTVFLDHENANKILNRPKRYNSGKLEEFVQGNLER
ECMEEKCSFEEAREVFENTERTTEFWKQYVDGDQCESNPCLNGGSCKDDINSYECWCPFGFE
GKNCELDVTCNIKNGRCEQFCKNSADNKVVCSCTEGYRLAENQKSCEPAVPFPCGRVSVSQT

-continued

SKLTRAETVFPDVDYVNSTEAE**GAPGSPAGSPTSTEEGTSESATPESGPGSEPATSGSETPA
SS**TILDNITQSTQSFNDFTRVVGGEDAKPGQFPWQVVLNGKVDAFCGGSIVNEKWIVTAAHC
VETGVKITVVAGEHNIEETEHTEQKRNVIRIIPHHNYNAAINKYNHDIALLELDEPLVLNSY
VTPICIADKEYTNIFLKFGSGYVSGWGRVFHKGRSALVLQYLRVPLVDRATCLLSTKFTIYN
NMFCAGFHEGGRDSCQGDSGGPHVTEVEGTSFLTGIISWGEECAMKGKYGIYTKVSRYVNWI
KEKTKLTGPEGPSKLTRAETGAGSPGAETAEQKLISEEDLSPATGHHHHHHHH

SEQ ID NO: 61 D0166_AE42 pNL123
MQRVNMIMAESPGLITICLLGYLLSAECTVFLDHENANKILNRPKRYNSGKLEEFVQGNLER

ECMEEKCSFEEAREVFENTERTTEFWKQYVDGDQCESNPCLNGGSCKDDINSYECWCPFGFE
GKNCELDVTCNIKNGRCEQFCKNSADNKVVCSCTEGYRLAENQKSCEPAVPFPCGRVSVSQT
SKLTRAETVFPDVDYVNSTEAETILD**GAPGSPAGSPTSTEEGTSESATPESGPGSEPATSGS
ETPASS**NITQSTQSFNDFTRVVGGEDAKPGQFPWQVVLNGKVDAFCGGSIVNEKWIVTAAHC
VETGVKITVVAGEHNIEETEHTEQKRNVIRIIPHHNYNAAINKYNHDIALLELDEPLVLNSY
VTPICIADKEYTNIFLKFGSGYVSGWGRVFHKGRSALVLQYLRVPLVDRATCLLSTKFTIYN
NMFCAGFHEGGRDSCQGDSGGPHVTEVEGTSFLTGIISWGEECAMKGKYGIYTKVSRYVNWI
KEKTKLTGPEGPSKLTRAETGAGSPGAETAEQKLISEEDLSPATGHHHHHHHH

SEQ ID NO: 62 S0174_AE42 pNL124
MQRVNMIMAESPGLITICLLGYLLSAECTVFLDHENANKILNRPKRYNSGKLEEFVQGNLER

ECMEEKCSFEEAREVFENTERTTEFWKQYVDGDQCESNPCLNGGSCKDDINSYECWCPFGFE
GKNCELDVTCNIKNGRCEQFCKNSADNKVVCSCTEGYRLAENQKSCEPAVPFPCGRVSVSQT
SKLTRAETVFPDVDYVNSTEAETILDNITQSTQS**GAPGSPAGSPTSTEEGTSESATPESGPG
SEPATSGSETPASS**FNDFTRVVGGEDAKPGQFPWQVVLNGKVDAFCGGSIVNEKWIVTAAHC
VETGVKITVVAGEHNIEETEHTEQKRNVIRIIPHHNYNAAINKYNHDIALLELDEPLVLNSY
VTPICIADKEYTNIFLKFGSGYVSGWGRVFHKGRSALVLQYLRVPLVDRATCLLSTKFTIYN
NMFCAGFHEGGRDSCQGDSGGPHVTEVEGTSFLTGIISWGEECAMKGKYGIYTKVSRYVNWI
KEKTKLTGPEGPSKLTRAETGAGSPGAETAEQKLISEEDLSPATGHHHHHHHH

SEQ ID NO: 63 K0188_AE42 pNL125
MQRVNMIMAESPGLITICLLGYLLSAECTVFLDHENANKILNRPKRYNSGKLEEFVQGNLER

ECMEEKCSFEEAREVFENTERTTEFWKQYVDGDQCESNPCLNGGSCKDDINSYECWCPFGFE
GKNCELDVTCNIKNGRCEQFCKNSADNKVVCSCTEGYRLAENQKSCEPAVPFPCGRVSVSQT
SKLTRAETVFPDVDYVNSTEAETILDNITQSTQSFNDFTRVVGGEDAK**GAPGSPAGSPTSTE
EGTSESATPESGPGSEPATSGSETPASS**PGQFPWQVVLNGKVDAFCGGSIVNEKWIVTAAHC
VETGVKITVVAGEHNIEETEHTEQKRNVIRIIPHHNYNAAINKYNHDIALLELDEPLVLNSY
VTPICIADKEYTNIFLKFGSGYVSGWGRVFHKGRSALVLQYLRVPLVDRATCLLSTKFTIYN
NMFCAGFHEGGRDSCQGDSGGPHVTEVEGTSFLTGIISWGEECAMKGKYGIYTKVSRYVNWI
KEKTKLTGPEGPSKLTRAETGAGSPGAETAEQKLISEEDLSPATGHHHHHHHH

SEQ ID NO: 64 V0202_AE42 pNL126
MQRVNMIMAESPGLITICLLGYLLSAECTVFLDHENANKILNRPKRYNSGKLEEFVQGNLER

ECMEEKCSFEEAREVFENTERTTEFWKQYVDGDQCESNPCLNGGSCKDDINSYECWCPFGFE
GKNCELDVTCNIKNGRCEQFCKNSADNKVVCSCTEGYRLAENQKSCEPAVPFPCGRVSVSQT
SKLTRAETVFPDVDYVNSTEAETILDNITQSTQSFNDFTRVVGGEDAKPGQFPWQVVLNGKV
GAPGSPAGSPTSTEEGTSESATPESGPGSEPATSGSETPASSDAFCGGSIVNEKWIVTAAHC
VETGVKITVVAGEHNIEETEHTEQKRNVIRIIPHHNYNAAINKYNHDIALLELDEPLVLNSY
VTPICIADKEYTNIFLKFGSGYVSGWGRVFHKGRSALVLQYLRVPLVDRATCLLSTKFTIYN
NMFCAGFHEGGRDSCQGDSGGPHVTEVEGTSFLTGIISWGEECAMKGKYGIYTKVSRYVNWI
KEKTKLTGPEGPSKLTRAETGAGSPGAETAEQKLISEEDLSPATGHHHHHHHH

SEQ ID NO: 65 E0224_AE42 pNL127
MQRVNMIMAESPGLITICLLGYLLSAECTVFLDHENANKILNRPKRYNSGKLEEFVQGNLER

ECMEEKCSFEEAREVFENTERTTEFWKQYVDGDQCESNPCLNGGSCKDDINSYECWCPFGFE
GKNCELDVTCNIKNGRCEQFCKNSADNKVVCSCTEGYRLAENQKSCEPAVPFPCGRVSVSQT
SKLTRAETVFPDVDYVNSTEAETILDNITQSTQSFNDFTRVVGGEDAKPGQFPWQVVLNGKV
DAFCGGSIVNEKWIVTAAHCVE**GAPGSPAGSPTSTEEGTSESATPESGPGSEPATSGSS
SS**TGVKITVVAGEHNIEETEHTEQKRNVIRIIPHHNYNAAINKYNHDIALLELDEPLVLNSY
VTPICIADKEYTNIFLKFGSGYVSGWGRVFHKGRSALVLQYLRVPLVDRATCLLSTKFTIYN
NMFCAGFHEGGRDSCQGDSGGPHVTEVEGTSFLTGIISWGEECAMKGKYGIYTKVSRYVNWI
KEKTKLTGPEGPSKLTRAETGAGSPGAETAEQKLISEEDLSPATGHHHHHHHH

SEQ ID NO: 66 E0240_AE42 pNL128
MQRVNMIMAESPGLITICLLGYLLSAECTVFLDHENANKILNRPKRYNSGKLEEFVQGNLER

ECMEEKCSFEEAREVFENTERTTEFWKQYVDGDQCESNPCLNGGSCKDDINSYECWCPFGFE
GKNCELDVTCNIKNGRCEQFCKNSADNKVVCSCTEGYRLAENQKSCEPAVPFPCGRVSVSQT
SKLTRAETVFPDVDYVNSTEAETILDNITQSTQSFNDFTRVVGGEDAKPGQFPWQVVLNGKV
DAFCGGSIVNEKWIVTAAHCVETGVKITVVAGEHNIEE**GAPGSPAGSPTSTEEGTSESATPE
SGPGSEPATSGSETPASS**TEHTEQKRNVIRIIPHHNYNAAINKYNHDIALLELDEPLVLNSY

-continued
```
VTPICIADKEYTNIFLKFGSGYVSGWGRVFHKGRSALVLQYLRVPLVDRATCLLSTKFTIYN
NMFCAGFHEGGRDSCQGDSGGPHVTEVEGTSFLTGIISWGEECAMKGKYGIYTKVSRYVNWI
KEKTKLTGPEGPSKLTRAETGAGSPGAETAEQKLISEEDLSPATGHHHHHHHH SEQ ID NO: 67 H0257_AE42 pNL129
 MQRVNMIMAESPGLITICLLGYLLSAECTVFLDHENANKILNRPKRYNSGKLEEFVQGNLER ECMEEKCSFEEAREVFENTERTTEFWKQYVDGDQCESNPCLNGGSCKDDINSYECWCPFGFE
GKNCELDVTCNIKNGRCEQFCKNSADNKVVCSCTEGYRLAENQKSCEPAVPFPCGRVSVSQT
SKLTRAETVFPDVDYVNSTEAETILDNITQSTQSFNDFTRVVGGEDAKPGQFPWQVVLNGKV
DAFCGGSIVNEKWIVTAAHCVETGVKITVVAGEHNIEETEHTEQKRNVIRIIPHHGAPGSPA
GSPTSTEEGTSESATPESGPGSEPATSGSETPASSNYNAAINKYNHDIALLELDEPLVLNSY
VTPICIADKEYTNIFLKFGSGYVSGWGRVFHKGRSALVLQYLRVPLVDRATCLLSTKFTIYN
NMFCAGFHEGGRDSCQGDSGGPHVTEVEGTSFLTGIISWGEECAMKGKYGIYTKVSRYVNWI
KEKTKLTGPEGPSKLTRAETGAGSPGAETAEQKLISEEDLSPATGHHHHHHHH SEQ ID NO: 68 K0265_AE42 pNL130
 MQRVNMIMAESPGLITICLLGYLLSAECTVFLDHENANKILNRPKRYNSGKLEEFVQGNLER ECMEEKCSFEEAREVFENTERTTEFWKQYVDGDQCESNPCLNGGSCKDDINSYECWCPFGFE
GKNCELDVTCNIKNGRCEQFCKNSADNKVVCSCTEGYRLAENQKSCEPAVPFPCGRVSVSQT
SKLTRAETVFPDVDYVNSTEAETILDNITQSTQSFNDFTRVVGGEDAKPGQFPWQVVLNGKV
DAFCGGSIVNEKWIVTAAHCVETGVKITVVAGEHNIEETEHTEQKRNVIRIIPHHNYNAAIN
KGAPGSPAGSPTSTEEGTSESATPESGPGSEPATSGSETPASSYNHDIALLELDEPLVLNSY
VTPICIADKEYTNIFLKFGSGYVSGWGRVFHKGRSALVLQYLRVPLVDRATCLLSTKFTIYN
NMFCAGFHEGGRDSCQGDSGGPHVTEVEGTSFLTGIISWGEECAMKGKYGIYTKVSRYVNWI
KEKTKLTGPEGPSKLTRAETGAGSPGAETAEQKLISEEDLSPATGHHHHHHHH SEQ ID NO: 69 E0277_AE42 pNL131
 MQRVNMIMAESPGLITICLLGYLLSAECTVFLDHENANKILNRPKRYNSGKLEEFVQGNLER ECMEEKCSFEEAREVFENTERTTEFWKQYVDGDQCESNPCLNGGSCKDDINSYECWCPFGFE
GKNCELDVTCNIKNGRCEQFCKNSADNKVVCSCTEGYRLAENQKSCEPAVPFPCGRVSVSQT
SKLTRAETVFPDVDYVNSTEAETILDNITQSTQSFNDFTRVVGGEDAKPGQFPWQVVLNGKV
DAFCGGSIVNEKWIVTAAHCVETGVKITVVAGEHNIEETEHTEQKRNVIRIIPHHNYNAAIN
KYNHDIALLELDEGAPGSPAGSPTSTEEGTSESATPESGPGSEPATSGSETPASSPLVLNSY
VTPICIADKEYTNIFLKFGSGYVSGWGRVFHKGRSALVLQYLRVPLVDRATCLLSTKFTIYN
NMFCAGFHEGGRDSCQGDSGGPHVTEVEGTSFLTGIISWGEECAMKGKYGIYTKVSRYVNWI
KEKTKLTGPEGPSKLTRAETGAGSPGAETAEQKLISEEDLSPATGHHHHHHHH SEQ ID NO: 70 D0292_AE42 pNL132
 MQRVNMIMAESPGLITICLLGYLLSAECTVFLDHENANKILNRPKRYNSGKLEEFVQGNLER ECMEEKCSFEEAREVFENTERTTEFWKQYVDGDQCESNPCLNGGSCKDDINSYECWCPFGFE
GKNCELDVTCNIKNGRCEQFCKNSADNKVVCSCTEGYRLAENQKSCEPAVPFPCGRVSVSQT
SKLTRAETVFPDVDYVNSTEAETILDNITQSTQSFNDFTRVVGGEDAKPGQFPWQVVLNGKV
DAFCGGSIVNEKWIVTAAHCVETGVKITVVAGEHNIEETEHTEQKRNVIRIIPHHNYNAAIN
KYNHDIALLELDEPLVLNSYVTPICIADGAPGSPAGSPTSTEEGTSESATPESGPGSEPATS
GSETPASSKEYTNIFLKFGSGYVSGWGRVFHKGRSALVLQYLRVPLVDRATCLLSTKFTIYN
NMFCAGFHEGGRDSCQGDSGGPHVTEVEGTSFLTGIISWGEECAMKGKYGIYTKVSRYVNWI
KEKTKLTGPEGPSKLTRAETGAGSPGAETAEQKLISEEDLSPATGHHHHHHHH SEQ ID NO: 71 K0316_AE42 pNL133
 MQRVNMIMAESPGLITICLLGYLLSAECTVFLDHENANKILNRPKRYNSGKLEEFVQGNLER ECMEEKCSFEEAREVFENTERTTEFWKQYVDGDQCESNPCLNGGSCKDDINSYECWCPFGFE
GKNCELDVTCNIKNGRCEQFCKNSADNKVVCSCTEGYRLAENQKSCEPAVPFPCGRVSVSQT
SKLTRAETVFPDVDYVNSTEAETILDNITQSTQSFNDFTRVVGGEDAKPGQFPWQVVLNGKV
DAFCGGSIVNEKWIVTAAHCVETGVKITVVAGEHNIEETEHTEQKRNVIRIIPHHNYNAAIN
KYNHDIALLELDEPLVLNSYVTPICIADKEYTNIFLKFGSGYVSGWGRVFHKGAPGSPAGSP
TSTEEGTSESATPESGPGSEPATSGSETPASSGRSALVLQYLRVPLVDRATCLLSTKFTIYN
NMFCAGFHEGGRDSCQGDSGGPHVTEVEGTSFLTGIISWGEECAMKGKYGIYTKVSRYVNWI
KEKTKLTGPEGPSKLTRAETGAGSPGAETAEQKLISEEDLSPATGHHHHHHHH SEQ ID NO: 72 K0341_AE42 pNL134
 MQRVNMIMAESPGLITICLLGYLLSAECTVFLDHENANKILNRPKRYNSGKLEEFVQGNLER ECMEEKCSFEEAREVFENTERTTEFWKQYVDGDQCESNPCLNGGSCKDDINSYECWCPFGFE
GKNCELDVTCNIKNGRCEQFCKNSADNKVVCSCTEGYRLAENQKSCEPAVPFPCGRVSVSQT
SKLTRAETVFPDVDYVNSTEAETILDNITQSTQSFNDFTRVVGGEDAKPGQFPWQVVLNGKV
DAFCGGSIVNEKWIVTAAHCVETGVKITVVAGEHNIEETEHTEQKRNVIRIIPHHNYNAAIN
KYNHDIALLELDEPLVLNSYVTPICIADKEYTNIFLKFGSGYVSGWGRVFHKGRSALVLQYL
RVPLVDRATCLLSTKGAPGSPAGSPTSTEEGTSESATPESGPGSEPATSGSETPASSFTIYN
NMFCAGFHEGGRDSCQGDSGGPHVTEVEGTSFLTGIISWGEECAMKGKYGIYTKVSRYVNWI
KEKTKLTGPEGPSKLTRAETGAGSPGAETAEQKLISEEDLSPATGHHHHHHHH
```

SEQ ID NO: 73 H0354_AE42 pNL135
<u>MQRVNMIMAESPGLITICLLGYLLSAEC</u><u>TVFLDHENANKILNRPKR</u>YNSGKLEEFVQGNLER
ECMEEKCSFEEAREVFENTERTTEFWKQYVDGDQCESNPCLNGGSCKDDINSYECWCPFGFE
GKNCELDVTCNIKNGRCEQFCKNSADNKVVCSCTEGYRLAENQKSCEPAVPFPCGRVSVSQT
SKLTRAETVFPDVDYVNSTEAETILDNITQSTQSFNDFTRVVGGEDAKPGQFPWQVVLNGKV
DAFCGGSIVNEKWIVTAAHCVETGVKITVVAGEHNIEETEHTEQKRNVIRIIPHHNYNAAIN
KYNHDIALLELDEPLVLNSYVTPICIADKEYTNIFLKFGSGYVSGWRVFHKGRSALVLQYL
RVPLVDRATCLLSTKFTIYNNMFCAGFHGAPGSPAGSPTSTEEGTSESATPESGPGSEPATS
GSETPASSEGGRDSCQGDSGGPHVTEVEGTSFLTGIISWGEECAMKGKYGIYTKVSRYVNWI
KEKTKLT<u>GPEGPSKLTRAETGAGSPGAETAEQKLISEEDLSPATGHHHHHHHH</u>

SEQ ID NO: 74 K0392_AE42 pNL136
<u>MQRVNMIMAESPGLITICLLGYLLSAEC</u><u>TVFLDHENANKILNRPKR</u>YNSGKLEEFVQGNLER
ECMEEKCSFEEAREVFENTERTTEFWKQYVDGDQCESNPCLNGGSCKDDINSYECWCPFGFE
GKNCELDVTCNIKNGRCEQFCKNSADNKVVCSCTEGYRLAENQKSCEPAVPFPCGRVSVSQT
SKLTRAETVFPDVDYVNSTEAETILDNITQSTQSFNDFTRVVGGEDAKPGQFPWQVVLNGKV
DAFCGGSIVNEKWIVTAAHCVETGVKITVVAGEHNIEETEHTEQKRNVIRIIPHHNYNAAIN
KYNHDIALLELDEPLVLNSYVTPICIADKEYTNIFLKFGSGYVSGWRVFHKGRSALVLQYL
RVPLVDRATCLLSTKFTINNMFCAGFHEGGRDSCQGDSGGPHVTEVEGTSFLTGIISWGEE
CAMKGAPGSPAGSPTSTEEGTSESATPESGPGSEPATSGSETPASSGKYGIYTKVSRYVNWI
KEKTKLT<u>GPEGPSKLTRAETGAGSPGAETAEQKLISEEDLSPATGHHHHHHHH</u>

SEQ ID NO: 75 R0403_AE42 pNL137
<u>MQRVNMIMAESPGLITICLLGYLLSAEC</u><u>TVFLDHENANKILNRPKR</u>YNSGKLEEFVQGNLER
ECMEEKCSFEEAREVFENTERTTEFWKQYVDGDQCESNPCLNGGSCKDDINSYECWCPFGFE
GKNCELDVTCNIKNGRCEQFCKNSADNKVVCSCTEGYRLAENQKSCEPAVPFPCGRVSVSQT
SKLTRAETVFPDVDYVNSTEAETILDNITQSTQSFNDFTRVVGGEDAKPGQFPWQVVLNGKV
DAFCGGSIVNEKWIVTAAHCVETGVKITVVAGEHNIEETEHTEQKRNVIRIIPHHNYNAAIN
KYNHDIALLELDEPLVLNSYVTPICIADKEYTNIFLKFGSGYVSGWRVFHKGRSALVLQYL
RVPLVDRATCLLSTKFTIYNNMFCAGFHEGGRDSCQGDSGGPHVTEVEGTSFLTGIISWGEE
CAMKGKYGIYTKVSRGAPGSPAGSPTSTEEGTSESATPESGPGSEPATSGSETPASSYVNWI
KEKTKLT<u>GPEGPSKLTRAETGAGSPGAETAEQKLISEEDLSPATGHHHHHHHH</u>

SEQ ID NO: 76 K0413_AE42 pNL138
<u>MQRVNMIMAESPGLITICLLGYLLSAEC</u><u>TVFLDHENANKILNRPKR</u>YNSGKLEEFVQGNLER
ECMEEKCSFEEAREVFENTERTTEFWKQYVDGDQCESNPCLNGGSCKDDINSYECWCPFGFE
GKNCELDVTCNIKNGRCEQFCKNSADNKVVCSCTEGYRLAENQKSCEPAVPFPCGRVSVSQT
SKLTRAETVFPDVDYVNSTEAETILDNITQSTQSFNDFTRVVGGEDAKPGQFPWQVVLNGKV
DAFCGGSIVNEKWIVTAAHCVETGVKITVVAGEHNIEETEHTEQKRNVIRIIPHHNYNAAIN
KYNHDIALLELDEPLVLNSYVTPICIADKEYTNIFLKFGSGYVSGWRVFHKGRSALVLQYL
RVPLVDRATCLLSTKFTIYNNMFCAGFHEGGRDSCQGDSGGPHVTEVEGTSFLTGIISWGEE
CAMKGKYGIYTKVSRYVNWIKEKTKGAPGSPAGSPTSTEEGTSESATPESGPGSEPATSGSE
TPASSLTG<u>PEGPSKLTRAETGAGSPGAETAEQKLISEEDLSPATGHHHHHHHH</u>

SEQ ID NO: 77 CT_AE42 pNL140
<u>MQRVNMIMAESPGLITICLLGYLLSAEC</u><u>TVFLDHENANKILNRPKR</u>YNSGKLEEFVQGNLER
ECMEEKCSFEEAREVFENTERTTEFWKQYVDGDQCESNPCLNGGSCKDDINSYECWCPFGFE
GKNCELDVTCNIKNGRCEQFCKNSADNKVVCSCTEGYRLAENQKSCEPAVPFPCGRVSVSQT
SKLTRAETVFPDVDYVNSTEAETILDNITQSTQSFNDFTRVVGGEDAKPGQFPWQVVLNGKV
DAFCGGSIVNEKWIVTAAHCVETGVKITVVAGEHNIEETEHTEQKRNVIRIIPHHNYNAAIN
KYNHDIALLELDEPLVLNSYVTPICIADKEYTNIFLKFGSGYVSGWRVFHKGRSALVLQYL
RVPLVDRATCLLSTKFTIYNNMFCAGFHEGGRDSCQGDSGGPHVTEVEGTSFLTGIISWGEE
CAMKGKYGIYTKVSRYVNWIKEKTKLT<u>GAGSPGAETALVPRSFLLRNPNDKYEPFWEDEES</u>G
AGSPGAETAGAPGSPAGSPTSTEEGTSESATPESGPGSEPATSGSETPASS<u>GAETAEQKLIS</u>
<u>EEDLSPATGHHHHHHHH</u>

SEQ ID NO: 78 E0052_AE42 pNL141
<u>MQRVNMIMAESPGLITICLLGYLLSAEC</u><u>TVFLDHENANKILNRPKR</u>YNSGKLEEFVQGNLER
ECMEEKCSFEEAREVFENTERTTEFWKQYVDGDQCEGAPGSPAGSPTSTEEGTSESATPESG
PGSEPATSGSETPASSSNPCLNGGSCKDDINSYECWCPFGFEGKNCELDVTCNIKNGRCEQF
CKNSADNKVVCSCTEGYRLAENQKSCEPAVPFPCGRVSVSQTSKLTRAETVFPDVDYVNSTE
AETILDNITQSTQSFNDFTRVVGGEDAKPGQFPWQVVLNGKVDAFCGGSINEKWIVTAAHC
VETGVKITVVAGEHNIEETEHTEQKRNVIRIIPHHNYNAAINKYNHDIALLELDEPLVLNSY
VTPICIADKEYTNIFLKFGSGYVSGWRVFHKGRSALVLQYLRVPLVDRATCLLSTKFTIYN
NMFCAGFHEGGRDSCQGDSGGPHVTEVEGTSFLTGIISWGEECAMKGKYGIYTKVSRYVNWI
KEKTKLT<u>GPEGPSKLTRAETGAGSPGAETAEQKLISEEDLSPATGHHHHHHHH</u>

SEQ ID NO: 79 G0059_AE42 pNL142
MQRVNMIMAESPGLITICLLGYLLSAECTVFLDHENANKILNRPKRYNSGKLEEFVQGNLER
ECMEEKCSFEEAREVFENTERTTEFWKQYVDGDQCESNPCLNG**GAPGSPAGSPTSTEEGTSE
SATPESGPGSEPATSGSETPASS**GSCKDDINSYECWCPFGFEGKNCELDVTCNIKNGRCEQF
CKNSADNKVVCSCTEGYRLAENQKSCEPAVPFPCGRVSVSQTSKLTRAETVFPDVDYVNSTE
AETILDNITQSTQSFNDFTRVVGGEDAKPGQFPPWQVVLNGKVDAFCGGSIVNEKWIVTAAHC
VETGVKITVVAGEHNIEETEHTEQKRNVIRIIPHHNYNAAINKYNHDIALLELDEPLVLNSY
VTPICIADKEYTNIFLKFGSGYVSGWGRVFHKGRSALVLQYLRVPLVDRATCLLSTKFTIYN
NMFCAGFHEGGRDSCQGDSGGPHVTEVEGTSFLTGIISWGEECAMKGKYGIYTKVSRYVNWI
KEKTKLTGPEGPSKLTRAETGAGSPGAETAEQKLISEEDLSPATGHHHHHHHH

SEQ ID NO: 80 10066_AE42 pNL143
MQRVNMIMAESPGLITICLLGYLLSAECTVFLDHENANKILNRPKRYNSGKLEEFVQGNLER
ECMEEKCSFEEAREVFENTERTTEFWKQYVDGDQCESNPCLNGGSCKDDI**GAPGSPAGSPTS
TEEGTSESATPESGPGSEPATSGSETPASS**NSYECWCPFGFEGKNCELDVTCNIKNGRCEQF
CKNSADNKVVCSCTEGYRLAENQKSCEPAVPFPCGRVSVSQTSKLTRAETVFPDVDYVNSTE
AETILDNITQSTQSFNDFTRVVGGEDAKPGQFPPWQVVLNGKVDAFCGGSIVNEKWIVTAAHC
VETGVKITVVAGEHNIEETEHTEQKRNVIRIIPHHNYNAAINKYNHDIALLELDEPLVLNSY
VTPICIADKEYTNIFLKFGSGYVSGWGRVFHKGRSALVLQYLRVPLVDRATCLLSTKFTIYN
NMFCAGFHEGGRDSCQGDSGGPHVTEVEGTSFLTGIISWGEECAMKGKYGIYTKVSRYVNWI
KEKTKLTGPEGPSKLTRAETGAGSPGAETAEQKLISEEDLSPATGHHHHHHHH

SEQ ID NO: 81 K0080_AE42 pNL144
MQRVNMIMAESPGLITICLLGYLLSAECTVFLDHENANKILNRPKRYNSGKLEEFVQGNLER
ECMEEKCSFEEAREVFENTERTTEFWKQYVDGDQCESNPCLNGGSCKDDINSYECWCPFGFE
GKGAPGSPAGSPTSTEEGTSESATPESGPGSEPATSGSETPASSNCELDVTCNIKNGRCEQF
CKNSADNKVVCSCTEGYRLAENQKSCEPAVPFPCGRVSVSQTSKLTRAETVFPDVDYVNSTE
AETILDNITQSTQSFNDFTRVVGGEDAKPGQFPPWQVVLNGKVDAFCGGSIVNEKWIVTAAHC
VETGVKITVVAGEHNIEETEHTEQKRNVIRIIPHHNYNAAINKYNHDIALLELDEPLVLNSY
VTPICIADKEYTNIFLKFGSGYVSGWGRVFHKGRSALVLQYLRVPLVDRATCLLSTKFTIYN
NMFCAGFHEGGRDSCQGDSGGPHVTEVEGTSFLTGIISWGEECAMKGKYGIYTKVSRYVNWI
KEKTKLTGPEGPSKLTRAETGAGSPGAETAEQKLISEEDLSPATGHHHHHHHH

SEQ ID NO: 82 D0085_AE42 pNL145
MQRVNMIMAESPGLITICLLGYLLSAECTVFLDHENANKILNRPKRYNSGKLEEFVQGNLER
ECMEEKCSFEEAREVFENTERTTEFWKQYVDGDQCESNPCLNGGSCKDDINSYECWCPFGFE
GKNCELDGAPGSPAGSPTSTEEGTSESATPESGPGSEPATSGSETPASSVTCNIKNGRCEQF
CKNSADNKVVCSCTEGYRLAENQKSCEPAVPFPCGRVSVSQTSKLTRAETVFPDVDYVNSTE
AETILDNITQSTQSFNDFTRVVGGEDAKPGQFPPWQVVLNGKVDAFCGGSIVNEKWIVTAAHC
VETGVKITVVAGEHNIEETEHTEQKRNVIRIIPHHNYNAAINKYNHDIALLELDEPLVLNSY
VTPICIADKEYTNIFLKFGSGYVSGWGRVFHKGRSALVLQYLRVPLVDRATCLLSTKFTIYN
NMFCAGFHEGGRDSCQGDSGGPHVTEVEGTSFLTGIISWGEECAMKGKYGIYTKVSRYVNWI
KEKTKLTGPEGPSKLTRAETGAGSPGAETAEQKLISEEDLSPATGHHHHHHHH

SEQ ID NO: 83 CT_AE144 pNL164
MQRVNMIMAESPGLITICLLGYLLSAECTVFLDHENANKILNRPKRYNSGKLEEFVQGNLER
ECMEEKCSFEEAREVFENTERTTEFWKQYVDGDQCESNPCLNGGSCKDDINSYECWCPFGFE
GKNCELDVTCNIKNGRCEQFCKNSADNKVVCSCTEGYRLAENQKSCEPAVPFPCGRVSVSQT
SKLTRAETVFPDVDYVNSTEAETILDNITQSTQSFNDFTRVVGGEDAKPGQFPPWQVVLNGKV
DAFCGGSIVNEKWIVTAAHCVETGVKITVVAGEHNIEETEHTEQKRNVIRIIPHHNYNAAIN
KYNHDIALLELDEPLVLNSYVTPICIADKEYTNIFLKFGSGYVSGWGRVFHKGRSALVLQYL
RVPLVDRATCLLSTKFTIYNNMFCAGFHEGGRDSCQGDSGGPHVTEVEGTSFLTGIISWGEE
CAMKGKYGIYTKVSRYVNWIKEKTKLTGAGSPGAETALVPRSFLLRNPNDKYEPFWEDEESG
AGSPGAETA**GAPTSTEPSEGSAPGTSESATPESGPGTSESATPESGPGSE
PATSGSETPGSEPATSGSETPGSPAGSPTSTEEGTSTEPSEGSAPGTSTEPSEGSAPGSEPA
TSGSETPGTSESATPESGPGTSTEPSEGSAPGASS**GAETAEQKLISEEDLSPATGHHHHHH
H

SEQ ID NO: 84 CT_AE288 pNL165
MQRVNMIMAESPGLITICLLGYLLSAECTVFLDHENANKILNRPKRYNSGKLEEFVQGNLER
ECMEEKCSFEEAREVFENTERTTEFWKQYVDGDQCESNPCLNGGSCKDDINSYECWCPFGFE
GKNCELDVTCNIKNGRCEQFCKNSADNKVVCSCTEGYRLAENQKSCEPAVPFPCGRVSVSQT
SKLTRAETVFPDVDYVNSTEAETILDNITQSTQSFNDFTRVVGGEDAKPGQFPPWQVVLNGKV
DAFCGGSIVNEKWIVTAAHCVETGVKITVVAGEHNIEETEHTEQKRNVIRIIPHHNYNAAIN

KYNHDIALLELDEPLVLNSYVTPICIADKEYTNIFLKFGSGYVSGWGRVFHKGRSALVLQYL
RVPLVDRATCLLSTKFTIYNNMFCAGFHEGGRDSCQGDSGGPHVTEVEGTSFLTGIISWGEE
CAMKGKYGIYTKVSRYVNWIKEKTKLTGAGSPGAETALVPRSFLLRNPNDKYEPFWEDEESG

AGSPGAETAGAPGSPAGSPTSTEEGTSESATPESGPGTSTEPSEGSAPGSPAGSPTSTEEGT

SESATPESGPGTSTEPSEGSAPGSPAGSPTSTEEGTSESATPESGPGSEPATSGSETPGTSE
SATPESGPGSPAGSPTSTEEGSPAGSPTSTEEGTSTEPSEGSAPGTSESATPESGPGTSESA
TPESGPGTSESATPESGPGSEPATSGSETPGSEPATSGSETPGSPAGSPTSTEEGTSTEPSE
GSAPGTSTEPSEGSAPGSEPATSGSETPGTSESATPESGPGTSTEPSEGSAPASSGAETAEQ

KLISEEDLSPATGHHHHHHHH

SEQ ID NO: 85 CT_AE864 pNL166
MQRVNMIMAESPGLITICLLGYLLSAECTVFLDHENANKILNRPKRYNSGKLEEFVQGNLER
ECMEEKCSFEEAREVFENTERTTEFWKQYVDGDQCESNPCLNGGSCKDDINSYECWCPFGFE
GKNCELDVTCNIKNGRCEQFCKNSADNKVVCSCTEGYRLAENQKSCEPAVPFPCGRVSVSQT
SKLTRAETVFPDVDYVNSTEAETILDNITQSTQSFNDFTRVVGGEDAKPGQFPWQVVLNGKV
DAFCGGSIVNEKWIVTAAHCVETGVKITVVAGEHNIEETEHTEQKRNVIRIIPHHNYNAAIN
KYNHDIALLELDEPLVLNSYVTPICIADKEYTNIFLKFGSGYVSGWGRVFHKGRSALVLQYL
RVPLVDRATCLLSTKFTIYNNMFCAGFHEGGRDSCQGDSGGPHVTEVEGTSFLTGIISWGEE
CAMKGKYGIYTKVSRYVNWIKEKTKLTGAGSPGAETALVPRSFLLRNPNDKYEPFWEDEESG

AGSPGAETAGAPGSPAGSPTSTEEGTSESATPESGPGTSTEPSEGSAPGSPAGSPTSTEEGT

STEPSEGSAPGTSTEPSEGSAPGTSESATPESGPGSEPATSGSETPGSEPATSGSETPGSPA
GSPTSTEEGTSESATPESGPGTSTEPSEGSAPGTSTEPSEGSAPGSPAGSPTSTEEGTSTEP
SEGSAPGTSTEPSEGSAPGTSESATPESGPGTSTEPSEGSAPGTSESATPESGPGSEPATSG
SETPGTSTEPSEGSAPGTSESATPESGPGTSESATPESGPGSPAGSPTST
EEGTSESATPESGPGSEPATSGSETPGTSESATPESGPGTSTEPSEGSAPGTSTEPSEGSAP
GTSTEPSEGSAPGTSTEPSEGSAPGTSTEPSEGSAPGSPAGSPTSTEEGT
STEPSEGSAPGTSESATPESGPGSEPATSGSETPGTSESATPESGPGSEPATSGSETPGTSE
SATPESGPGTSTEPSEGSAPGTSESATPESGPGSPAGSPTSTEEGSPAGSPTSTEEGSPAGS
PTSTEEGTSESATPESGPGTSTEPSEGSAPGTSESATPESGPGSEPATSGSETPGTSESATP
ESGPGSEPATSGSETPGTSESATPESGPGTSTEPSEGSAPGSPAGSPTSTEEGTSESATPES
GPGSEPATSGSETPGTSESATPESGPGSPAGSPTSTEEGSPAGSPTSTEEGTSTEPSEGSAP
GTSESATPESGPGTSESATPESGPGTSESATPESGPGSEPATSGSETPGSEPATSGSETPGS
PAGSPTSTEEGTSTEPSEGSAPGTSTEPSEGSAPGSEPATSGSETPGTSESATPESGPGTST
EPSEGSAPASSGAETAEQKLISEEDLSPATGHHHHHHHH

SEQ ID NO: 86 K0142_AE72 pNL167
MQRVNMIMAESPGLITICLLGYLLSAECTVFLDHENANKILNRPKRYNSGKLEEFVQGNLER
ECMEEKCSFEEAREVFENTERTTEFWKQYVDGDQCESNPCLNGGSCKDDINSYECWCPFGFE
GKNCELDVTCNIKNGRCEQFCKNSADNKVVCSCTEGYRLAENQKSCEPAVPFPCGRVSVSQT
SKGAPSPAGSPTSTEEGTSESATPESGPGSEPATSGSETPGTSESATPESGPGTSTEPSEGS
APGTSTEPSEGSAPGASSLTRAETVFPDVDYVNSTEAETILDNITQSTQSFNDFTRVVGGED
AKPGQFPWQVVLNGKVDAFCGGSIVNEKWIVTAAHCVETGVKITVVAGEHNIEETEHTEQKR
NVIRIIPHHNYNAAINKYNHDIALLELDEPLVLNSYVTPICIADKEYTNIFLKFGSGYVSGW
GRVFHKGRSALVLQYLRVPLVDRATCLLSTKFTIYNNMFCAGFHEGGRDSCQGDSGGPHVTE
VEGTSFLTGIISWGEECAMKGKYGIYTKVSRYVNWIKEKTKLTGPEGPSKLTRAETGAGSPG

AETAEQKLISEEDLSPATGHHHHHHHH

SEQ ID NO: 87 K0142_AE144 pNL168
MQRVNMIMAESPGLITICLLGYLLSAECTVFLDHENANKILNRPKRYNSGKLEEFVQGNLER
ECMEEKCSFEEAREVFENTERTTEFWKQYVDGDQCESNPCLNGGSCKDDINSYECWCPFGFE
GKNCELDVTCNIKNGRCEQFCKNSADNKVVCSCTEGYRLAENQKSCEPAVPFPCGRVSVSQT
SKGAPSPAGSPTSTEEGTSESATPESGPGSEPATSGSETPGTSESATPESGPGTSTEPSEGS
APGTSTEPSEGSAPGTSTEPSEGSAPGTSTEPSEGSAPGTSTEPSEGSAP
GSPAGSPTSTEEGTSTEPSEGSAPGASSLTRAETVFPDVDYVNSTEAETILDNITQSTQSFN
DFTRVVGGEDAKPGQFPWQVVLNGKVDAFCGGSIVNEKWIVTAAHCVETGVKITVVAGEHNI
EETEHTEQKRNVIRIIPHHNYNAAINKYNHDIALLELDEPLVLNSYVTPICIADKEYTNIFL
KFGSGYVSGWGRVFHKGRSALVLQYLRVPLVDRATCLLSTKFTIYNNMFCAGFHEGGRDSCQ
GDSGGPHVTEVEGTSFLTGIISWGEECAMKGKYGIYTKVSRYVNWIKEKTKLTGPEGPSKLT

RAETGAGSPGAETAEQKLISEEDLSPATGHHHHHHHH

SEQ ID NO: 88 K0142_AE288 pNL169
MQRVNMIMAESPGLITICLLGYLLSAECTVFLDHENANKILNRPKRYNSGKLEEFVQGNLER
ECMEEKCSFEEAREVFENTERTTEFWKQYVDGDQCESNPCLNGGSCKDDINSYECWCPFGFE
GKNCELDVTCNIKNGRCEQFCKNSADNKVVCSCTEGYRLAENQKSCEPAVPFPCGRVSVSQT
SKGAPGTSESATPESGPGSEPATSGSETPGTSESATPESGPGSEPATSGSETPGTSESATPE
SGPGTSTEPSEGSAPGSPAGSPTSTEEGTSESATPESGPGSEPATSGSETPGTSESATPESG
PGSPAGSPTSTEEGSPAGSPTSTEEGTSTEPSEGSAPGTSESATPESGPGTSESATPESGPG
TSESATPESGPGSEPATSGSETPGSEPATSGSETPGSPAGSPTSTEEGTSTEPSEGSAPGTS

TEPSEGSAPGSEPATSGSETPGTSESATPESGPGTSTEPSEGSAPASSLTRAETVFPDVDYV
NSTEAETILDNITQSTQSFNDFTRVVGGEDAKPGQFPWQVVLNGKVDAFCGGSIVNEKWIVT
AAHCVETGVKITVVAGEHNIEETEHTEQKRNVIRIIPHHNYNAAINKYNHDIALLELDEPLV
LNSYVTPICIADKEYTNIFLKFGSGYVSGWGRVFHKGRSALVLQYLRVPLVDRATCLLSTKF
TIYNNMFCAGFHEGGRDSCQGDSGGPHVTEVEGTSFLTGIISWGEECAMKGKYGIYTKVSRY
VNWIKEKTKLTGPEGPSKLTRAETGAGSPGAETAEQKLISEEDLSPATGHHHHHHHH

SEQ ID NO: 89 V0149_AE72 pNL170
MQRVNMIMAESPGLITICLLGYLLSAECTVFLDHENANKILNRPKRYNSGKLEEFVQGNLER

ECMEEKCSFEEAREVFENTERTTEFWKQYVDGDQCESNPCLNGGSCKDDINSYECWCPFGFE
GKNCELDVTCNIKNGRCEQFCKNSADNKVVCSCTEGYRLAENQKSCEPAVPFPCGRVSVSQT
SKLTRAETV**GAPSPAGSPTSTEEGTSESATPESGPGSEPATSGSETPGTSESATPESGPGTS
TEPSEGSAPGTSTEPSEGSAPGASS**FPDVDYVNSTEAETILDNITQSTQSFNDFTRVVGGED
AKPGQFPWQVVLNGKVDAFCGGSIVNEKWIVTAAHCVETGVKITVVAGEHNIEETEHTEQKR
NVIRIIPHHNYNAAINKYNHDIALLELDEPLVLNSYVTPICIADKEYTNIFLKFGSGYVSGW
GRVFHKGRSALVLQYLRVPLVDRATCLLSTKFTIYNNMFCAGFHEGGRDSCQGDSGGPHVTE
VEGTSFLTGIISWGEECAMKGKYGIYTKVSRYVNWIKEKTKLTGPEGPSKLTRAETGAGSPG

AETAEQKLISEEDLSPATGHHHHHHHH

SEQ ID NO: 90 V0149_AE144 pNL171
MQRVNMIMAESPGLITICLLGYLLSAECTVFLDHENANKILNRPKRYNSGKLEEFVQGNLER

ECMEEKCSFEEAREVFENTERTTEFWKQYVDGDQCESNPCLNGGSCKDDINSYECWCPFGFE
GKNCELDVTCNIKNGRCEQFCKNSADNKVVCSCTEGYRLAENQKSCEPAVPFPCGRVSVSQT
SKLTRAETV**GAPSPAGSPTSTEEGTSESATPESGPGSEPATSGSETPGTSESATPESGPGTS
TEPSEGSAPGTSTEPSEGSAPGTSTEPSEGSAPGTSTEPSEGSAPGTSTE
PSEGSAPGSPAGSPTSTEEGTSTEPSEGSAPGASS**FPDVDYVNSTEAETILDNITQSTQSFN
DFTRVVGGEDAKPGQFPWQVVLNGKVDAFCGGSIVNEKWIVTAAHCVETGVKITVVAGEHNI
EETEHTEQKRNVIRIIPHHNYNAAINKYNHDIALLELDEPLVLNSYVTPICIADKEYTNIFL
KFGSGYVSGWGRVFHKGRSALVLQYLRVPLVDRATCLLSTKFTIYNNMFCAGFHEGGRDSCQ
GDSGGPHVTEVEGTSFLTGIISWGEECAMKGKYGIYTKVSRYVNWIKEKTKLTGPEGPSKLT

RAETGAGSPGAETAEQKLISEEDLSPATGHHHHHHHH

SEQ ID NO: 91 V0149_AE288 pNL172
MQRVNMIMAESPGLITICLLGYLLSAECTVFLDHENANKILNRPKRYNSGKLEEFVQGNLER

ECMEEKCSFEEAREVFENTERTTEFWKQYVDGDQCESNPCLNGGSCKDDINSYECWCPFGFE
GKNCELDVTCNIKNGRCEQFCKNSADNKVVCSCTEGYRLAENQKSCEPAVPFPCGRVSVSQT
SKLTRAETV**GAPGTSESATPESGPGSEPATSGSETPGTSESATPESGPGSEPATSGSETPGT
SESATPESGPGTSTEPSEGSAPGSPAGSPTSTEEGTSESATPESGPGSEPATSGSETPGTSE
SATPESGPGSPAGSPTSTEEGSPAGSPTSTEEGTSTEPSEGSAPGTSESATPESGPGTSESA
TPESGPGTSESATPESGPGSEPATSGSETPGSEPATSGSETPGSPAGSPTSTEEGTSTEPSE
GSAPGTSTEPSEGSAPGSEPATSGSETPGTSESATPESGPGTSTEPSEGSAPASS**FPDVDYV
NSTEAETILDNITQSTQSFNDFTRVVGGEDAKPGQFPWQVVLNGKVDAFCGGSIVNEKWIVT
AAHCVETGVKITVVAGEHNIEETEHTEQKRNVIRIIPHHNYNAAINKYNHDIALLELDEPLV
LNSYVTPICIADKEYTNIFLKFGSGYVSGWGRVFHKGRSALVLQYLRVPLVDRATCLLSTKF
TIYNNMFCAGFHEGGRDSCQGDSGGPHVTEVEGTSFLTGIISWGEECAMKGKYGIYTKVSRY
VNWIKEKTKLTGPEGPSKLTRAETGAGSPGAETAEQKLISEEDLSPATGHHHHHHHH

SEQ ID NO: 92 E0162_AE72 pNL173
MQRVNMIMAESPGLITICLLGYLLSAECTVFLDHENANKILNRPKRYNSGKLEEFVQGNLER

ECMEEKCSFEEAREVFENTERTTEFWKQYVDGDQCESNPCLNGGSCKDDINSYECWCPFGFE
GKNCELDVTCNIKNGRCEQFCKNSADNKVVCSCTEGYRLAENQKSCEPAVPFPCGRVSVSQT
SKLTRAETVFPDVDYVNSTEAE**GAPSPAGSPTSTEEGTSESATPESGPGSEPATSGSETPGT
SESATPESGPGTSTEPSEGSAPGTSTEPSEGSAPGASS**TILDNITQSTQSFNDFTRVVGGED
AKPGQFPWQVVLNGKVDAFCGGSIVNEKWIVTAAHCVETGVKITVVAGEHNIEETEHTEQKR
NVIRIIPHHNYNAAINKYNHDIALLELDEPLVLNSYVTPICIADKEYTNIFLKFGSGYVSGW
GRVFHKGRSALVLQYLRVPLVDRATCLLSTKFTIYNNMFCAGFHEGGRDSCQGDSGGPHVTE
VEGTSFLTGIISWGEECAMKGKYGIYTKVSRYVNWIKEKTKLTGPEGPSKLTRAETGAGSPG

AETAEQKLISEEDLSPATGHHHHHHHH

SEQ ID NO: 93 E0162_AE144 pNL174
MQRVNMIMAESPGLITICLLGYLLSAECTVFLDHENANKILNRPKRYNSGKLEEFVQGNLER

ECMEEKCSFEEAREVFENTERTTEFWKQYVDGDQCESNPCLNGGSCKDDINSYECWCPFGFE
GKNCELDVTCNIKNGRCEQFCKNSADNKVVCSCTEGYRLAENQKSCEPAVPFPCGRVSVSQT
SKLTRAETVFPDVDYVNSTEAE**GAPSPAGSPTSTEEGTSESATPESGPGSEPATSGSETPGT
SESATPESGPGTSTEPSEGSAPGTSTEPSEGSAPGTSTEPSEGSAPGTST
EPSEGSAPGTSTEPSEGSAPGSPAGSPTSTEEGTSTEPSEGSAPGASS**TILDNITQSTQSFN

```
DFTRVVGGEDAKPGQFPWQVVLNGKVDAFCGGSIVNEKWIVTAAHCVETGVKITVVAGEHNI
EETEHTEQKRNVIRIIPHHNYNAAINKYNHDIALLELDEPLVLNSYVTPICIADKEYTNIFL
KFGSGYVSGWRVFHKGRSALVLQYLRVPLVDRATCLLSTKFTIYNNMFCAGFHEGGRDSCQ
GDSGGPHVTEVEGTSFLTGIISWGEECAMKGKYGIYTKVSRYVNWIKEKTKLTGPEGPSKLT

RAETGAGSPGAETAEQKLISEEDLSPATGHHHHHHHH

SEQ ID NO: 94 E0162_AE288 pNL175
MQRVNMIMAESPGLITICLLGYLLSAECTVFLDHENANKILNRPKRYNSGKLEEFVQGNLER

ECMEEKCSFEEAREVFENTERTTEFWKQYVDGDQCESNPCLNGGSCKDDINSYECWCPFGFE
GKNCELDVTCNIKNGRCEQFCKNSADNKVVCSCTEGYRLAENQKSCEPAVPFPCGRVSVSQT
SKLTRAETVFPDVDYVNSTEAEGAPGTSESATPESGPGSEPATSGSETPGTSESATPESGPG
SEPATSGSETPGTSESATPESGPGTSTEPSEGSAPGSPAGSPTSTEEGTSESATPESGPGSE
PATSGSETPGTSESATPESGPGSPAGSPTSTEEGSPAGSPTSTEEGTSTEPSEGSAPGTSES
ATPESGPGTSESATPESGPGTSESATPESGPGSEPATSGSETPGSEPATSGSETPGSPAGSP
TSTEEGTSTEPSEGSAPGTSTEPSEGSAPGSEPATSGSETPGTSESATPESGPGTSTEPSEG
SAPASSTILDNITQSTQSFNDFTRVVGGEDAKPGQFPWQVVLNGKVDAFCGGSIVNEKWIVT
AAHCVETGVKITVVAGEHNIEETEHTEQKRNVIRIIPHHNYNAAINKYNHDIALLELDEPLV
LNSYVTPICIADKEYTNIFLKFGSGYVSGWRVFHKGRSALVLQYLRVPLVDRATCLLSTKFT
IYNNMFCAGFHEGGRDSCQGDSGGPHVTEVEGTSFLTGIISWGEECAMKGKYGIYTKVSRY
VNWIKEKTKLTGPEGPSKLTRAETGAGSPGAETAEQKLISEEDLSPATGHHHHHHHH

SEQ ID NO: 95 D0166_AE72 pNL176
MQRVNMIMAESPGLITICLLGYLLSAECTVFLDHENANKILNRPKRYNSGKLEEFVQGNLER

ECMEEKCSFEEAREVFENTERTTEFWKQYVDGDQCESNPCLNGGSCKDDINSYECWCPFGFE
GKNCELDVTCNIKNGRCEQFCKNSADNKVVCSCTEGYRLAENQKSCEPAVPFPCGRVSVSQT
SKLTRAETVFPDVDYVNSTEAETILDGAPSPAGSPTSTEEGTSESATPESGPGSEPATSGSE
TPGTSESATPESGPGTSTEPSEGSAPGTSTEPSEGSAPGASSNITQSTQSFNDFTRVVGGED
AKPGQFPWQVVLNGKVDAFCGGSIVNEKWIVTAAHCVETGVKITVVAGEHNIEETEHTEQKR
NVIRIIPHHNYNAAINKYNHDIALLELDEPLVLNSYVTPICIADKEYTNIFLKFGSGYVSGW
GRVFHKGRSALVLQYLRVPLVDRATCLLSTKFTIYNNMFCAGFHEGGRDSCQGDSGGPHVTE
VEGTSFLTGIISWGEECAMKGKYGIYTKVSRYVNWIKEKTKLTGPEGPSKLTRAETGAGSPG

AETAEQKLISEEDLSPATGHHHHHHHH

SEQ ID NO: 96 D0166_AE144 pNL177
MQRVNMIMAESPGLITICLLGYLLSAECTVFLDHENANKILNRPKRYNSGKLEEFVQGNLER

ECMEEKCSFEEAREVFENTERTTEFWKQYVDGDQCESNPCLNGGSCKDDINSYECWCPFGFE
GKNCELDVTCNIKNGRCEQFCKNSADNKVVCSCTEGYRLAENQKSCEPAVPFPCGRVSVSQT
SKLTRAETVFPDVDYVNSTEAETILDGAPSPAGSPTSTEEGTSESATPESGPGSEPATSGSE
TPGTSESATPESGPGTSTEPSEGSAPGTSTEPSEGSAPGTSTEPSEGSAPGTSTEPSEGSAP
GTSTEPSEGSAPGTSTEPSEGSAPGSPAGSPTSTEEGTSTEPSEGSAPGASSNITQSTQSFN
DFTRVVGGEDAKPGQFPWQVVLNGKVDAFCGGSIVNEKWIVTAAHCVETGVKITVVAGEHNI
EETEHTEQKRNVIRIIPHHNYNAAINKYNHDIALLELDEPLVLNSYVTPICIADKEYTNIFL
KFGSGYVSGWRVFHKGRSALVLQYLRVPLVDRATCLLSTKFTIYNNMFCAGFHEGGRDSCQ
GDSGGPHVTEVEGTSFLTGIISWGEECAMKGKYGIYTKVSRYVNWIKEKTKLTGPEGPSKLT

RAETGAGSPGAETAEQKLISEEDLSPATGHHHHHHHH

SEQ ID NO: 97 D0166_AE288 pNL178
MQRVNMIMAESPGLITICLLGYLLSAECTVFLDHENANKILNRPKRYNSGKLEEFVQGNLER

ECMEEKCSFEEAREVFENTERTTEFWKQYVDGDQCESNPCLNGGSCKDDINSYECWCPFGFE
GKNCELDVTCNIKNGRCEQFCKNSADNKVVCSCTEGYRLAENQKSCEPAVPFPCGRVSVSQT
SKLTRAETVFPDVDYVNSTEAETILDGAPGTSESATPESGPGSEPATSGSETPGTSESATPE
SGPGSEPATSGSETPGTSESATPESGPGTSTEPSEGSAPGSPAGSPTSTEEGTSESATPESG
PGSEPATSGSETPGTSESATPESGPGSPAGSPTSTEEGSPAGSPTSTEEGTSTEPSEGSAPG
TSESATPESGPGTSESATPESGPGTSESATPESGPGSEPATSGSETPGSEPATSGSETPGSP
AGSPTSTEEGTSTEPSEGSAPGTSTEPSEGSAPGSEPATSGSETPGSESATPESGPGTSTE
PSEGSAPASSNITQSTQSFNDFTRVVGGEDAKPGQFPWQVVLNGKVDAFCGGSIVNEKWIVT
AAHCVETGVKITVVAGEHNIEETEHTEQKRNVIRIIPHHNYNAAINKYNHDIALLELDEPLV
LNSYVTPICIADKEYTNIFLKFGSGYVSGWRVFHKGRSALVLQYLRVPLVDRATCLLSTKF
TIYNNMFCAGFHEGGRDSCQGDSGGPHVTEVEGTSFLTGIISWGEECAMKGKYGIYTKVSRY
VNWIKEKTKLTGPEGPSKLTRAETGAGSPGAETAEQKLISEEDLSPATGHHHHHHHH

SEQ ID NO: 98 S0174_AE72 pNL179
MQRVNMIMAESPGLITICLLGYLLSAECTVFLDHENANKILNRPKRYNSGKLEEFVQGNLER

ECMEEKCSFEEAREVFENTERTTEFWKQYVDGDQCESNPCLNGGSCKDDINSYECWCPFGFE
GKNCELDVTCNIKNGRCEQFCKNSADNKVVCSCTEGYRLAENQKSCEPAVPFPCGRVSVSQT
SKLTRAETVFPDVDYVNSTEAETILDNITQSTQSGAPSPAGSPTSTEEGTSESATPESGPGS
EPATSGSETPGTSESATPESGPGTSTEPSEGSAPGTSTEPSEGSAPGASSFNDFTRVVGGED
```

```
AKPGQFPWQVVLNGKVDAFCGGSIVNEKWIVTAAHCVETGVKITVVAGEHNIEETEHTEQKR
NVIRIIPHHNYNAAINKYNHDIALLELDEPLVLNSYVTPICIADKEYTNIFLKFGSGYVSGW
GRVFHKGRSALVLQYLRVPLVDRATCLLSTKFTIYNNMFCAGFHEGGRDSCQGDSGGPHVTE
VEGTSFLTGIISWGEECAMKGKYGIYTKVSRYVNWIKEKTKLTGPEGPSKLTRAETGAGSPG

AETAEQKLISEEDLSPATGHHHHHHHH

SEQ ID NO: 99 S0174_AE144 pNL180
MQRVNMIMAESPGLITICLLGYLLSAECTVFLDHENANKILNRPKRYNSGKLEEFVQGNLER

ECMEEKCSFEEAREVFENTERTTEFWKQYVDGDQCESNPCLNGGSCKDDINSYECWCPFGFE
GKNCELDVTCNIKNGRCEQFCKNSADNKVVCSCTEGYRLAENQKSCEPAVPFPCGRVSVSQT
SKLTRAETVFPDVDYVNSTEAETILDNITQSTQS**GAPSPAGSPTSTEEGTSESATPESGPGS
EPATSGSETPGTSESATPESGPGTSTEPSEGSAPGTSTEPSEGSAPGTSTEPSEGSAPGTST
EPSEGSAPGTSTEPSEGSAPGTSTEPSEGSAPGSPAGSPTSTEEGTSTEPSEGSAPGASS**FN
DFTRVVGGEDAKPGQFPWQVVLNGKVDAFCGGSIVNEKWIVTAAHCVETGVKITVVAGEHNI
EETEHTEQKRNVIRIIPHHNYNAAINKYNHDIALLELDEPLVLNSYVTPICIADKEYTNIFL
KFGSGYVSGWGRVFHKGRSALVLQYLRVPLVDRATCLLSTKFTIYNNMFCAGFHEGGRDSCQ
GDSGGPHVTEVEGTSFLTGIISWGEECAMKGKYGIYTKVSRYVNWIKEKTKLTGPEGPSKLT

RAETGAGSPGAETAEQKLISEEDLSPATGHHHHHHHH

SEQ ID NO: 100 S0174_AE288 pNL181
MQRVNMIMAESPGLITICLLGYLLSAECTVFLDHENANKILNRPKRYNSGKLEEFVQGNLER

ECMEEKCSFEEAREVFENTERTTEFWKQYVDGDQCESNPCLNGGSCKDDINSYECWCPFGFE
GKNCELDVTCNIKNGRCEQFCKNSADNKVVCSCTEGYRLAENQKSCEPAVPFPCGRVSVSQT
SKLTRAETVFPDVDYVNSTEAETILDNITQSTQS**GAPGTSESATPESGPGSEPATSGSETPG
TSESATPESGPGSEPATSGSETPGTSESATPESGPGTSTEPSEGSAPGSPAGSPTSTEEGTS
ESATPESGPGSEPATSGSETPGTSESATPESGPGSPAGSPTSTEEGSPAGSPTSTEEGTSTE
PSEGSAPGTSESATPESGPGTSESATPESGPGTSESATPESGPGSEPATSGSETPGSEPATS
GSETPGSPAGSPTSTEEGTSTEPSEGSAPGTSTEPSEGSAPGSEPATSGSETPGTSESATPE
SGPGTSTEPSEGSAPASS**FNDFTRVVGGEDAKPGQFPWQVVLNGKVDAFCGGSIVNEKWIVT
AAHCVETGVKITVVAGEHNIEETEHTEQKRNVIRIIPHHNYNAAINKYNHDIALLELDEPLV
LNSYVTPICIADKEYTNIFLKFGSGYVSGWGRVFHKGRSALVLQYLRVPLVDRATCLLSTKF
TIYNNMFCAGFHEGGRDSCQGDSGGPHVTEVEGTSFLTGIISWGEECAMKGKYGIYTKVSRY
VNWIKEKTKLTGPEGPSKLTRAETGAGSPGAETAEQKLISEEDLSPATGHHHHHHHH

SEQ ID NO: 101 E0224_AE72 pNL182
MQRVNMIMAESPGLITICLLGYLLSAECTVFLDHENANKILNRPKRYNSGKLEEFVQGNLER

ECMEEKCSFEEAREVFENTERTTEFWKQYVDGDQCESNPCLNGGSCKDDINSYECWCPFGFE
GKNCELDVTCNIKNGRCEQFCKNSADNKVVCSCTEGYRLAENQKSCEPAVPFPCGRVSVSQT
SKLTRAETVFPDVDYVNSTEAETILDNITQSTQSFNDFTRVVGGEDAKPGQFPWQVVLNGKV
DAFCGGSIVNEKWIVTAAHCVE**GAPSPAGSPTSTEEGTSESATPESGPGSEPATSGSETPGT
SESATPESGPGTSTEPSEGSAPGTSTEPSEGSAPGASS**TGVKITVVAGEHNIEETEHTEQKR
NVIRIIPHHNYNAAINKYNHDIALLELDEPLVLNSYVTPICIADKEYTNIFLKFGSGYVSGW
GRVFHKGRSALVLQYLRVPLVDRATCLLSTKFTIYNNMFCAGFHEGGRDSCQGDSGGPHVTE
VEGTSFLTGIISWGEECAMKGKYGIYTKVSRYVNWIKEKTKLTGPEGPSKLTRAETGAGSPG

AETAEQKLISEEDLSPATGHHHHHHHH

SEQ ID NO: 102 E0224_AE144 pNL183
MQRVNMIMAESPGLITICLLGYLLSAECTVFLDHENANKILNRPKRYNSGKLEEFVQGNLER

ECMEEKCSFEEAREVFENTERTTEFWKQYVDGDQCESNPCLNGGSCKDDINSYECWCPFGFE
GKNCELDVTCNIKNGRCEQFCKNSADNKVVCSCTEGYRLAENQKSCEPAVPFPCGRVSVSQT
SKLTRAETVFPDVDYVNSTEAETILDNITQSTQSFNDFTRVVGGEDAKPGQFPWQVVLNGKV
DAFCGGSIVNEKWIVTAAHCVE**GAPSPAGSPTSTEEGTSESATPESGPGSEPATSGSETPGT
SESATPESGPGTSTEPSEGSAPGTSTEPSEGSAPGTSTEPSEGSAPGTSTEPSEGSAPGTST
EPSEGSAPGTSTEPSEGSAPGSPAGSPTSTEEGTSTEPSEGSAPGASS**TGVKITVVAGEHNI
EETEHTEQKRNVIRIIPHHNYNAAINKYNHDIALLELDEPLVLNSYVTPICIADKEYTNIFL
KFGSGYVSGWGRVFHKGRSALVLQYLRVPLVDRATCLLSTKFTIYNNMFCAGFHEGGRDSCQ
GDSGGPHVTEVEGTSFLTGIISWGEECAMKGKYGIYTKVSRYVNWIKEKTKLTGPEGPSKLT

RAETGAGSPGAETAEQKLISEEDLSPATGHHHHHHHH

SEQ ID NO: 103 E0224_AE288 pNL184
MQRVNMIMAESPGLITICLLGYLLSAECTVFLDHENANKILNRPKRYNSGKLEEFVQGNLER

ECMEEKCSFEEAREVFENTERTTEFWKQYVDGDQCESNPCLNGGSCKDDINSYECWCPFGFE
GKNCELDVTCNIKNGRCEQFCKNSADNKVVCSCTEGYRLAENQKSCEPAVPFPCGRVSVSQT
SKLTRAETVFPDVDYVNSTEAETILDNITQSTQSFNDFTRVVGGEDAKPGQFPWQVVLNGKV
DAFCGGSIVNEKWIVTAAHCVE**GAPGTSESATPESGPGSEPATSGSETPGTSESATPESGPG
SEPATSGSETPGTSESATPESGPGTSTEPSEGSAPGSPAGSPTSTEEGTSESATPESGPGSE
PATSGSETPGTSESATPESGPGSPAGSPTSTEEGSPAGSPTSTEEGTSTEPSEGSAPGTSES
ATPESGPGTSESATPESGPGTSESATPESGPGSEPATSGSETPGSEPATSGSETPGSPAGSP
TSTEEGTSTEPSEGSAPGTSTEPSEGSAPGSEPATSGSETPGTSESATPESGPGTSTEPSEG**
```

-continued
```
SAPASSTGVKITVVAGEHNIEETEHTEQKRNVIRIIPHHNYNAAINKYNHDIALLELDEPLV
LNSYVTPICIADKEYTNIFLKFGSGYVSGWRVFHKGRSALVLQYLRVPLVDRATCLLSTKF
TIYNNMFCAGFHEGGRDSCQGDSGGPHVTEVEGTSFLTGIISWGEECAMKGKYGIYTKVSRY
VNWIKEKTKLTGPEGPSKLTRAETGAGSPGAETAEQKLISEEDLSPATGHHHHHHHH SEQ ID NO: 104 K0413_AE72 pNL185
MQRVNMIMAESPGLITICLLGYLLSAECTVFLDHENANKILNRPKRYNSGKLEEFVQGNLER ECMEEKCSFEEAREVFENTERTTEFWKQYVDGDQCESNPCLNGGSCKDDINSYECWCPFGFE
GKNCELDVTCNIKNGRCEQFCKNSADNKVVCSCTEGYRLAENQKSCEPAVPFPCGRVSVSQT
SKLTRAETVFPDVDYVNSTEAETILDNITQSTQSFNDFTRVVGGEDAKPGQFPWQVVLNGKV
DAFCGGSIVNEKWIVTAAHCVETGVKITVVAGEHNIEETEHTEQKRNVIRIIPHHNYNAAIN
KYNHDIALLELDEPLVLNSYVTPICIADKEYTNIFLKFGSGYVSGWRVFHKGRSALVLQYL
RVPLVDRATCLLSTKFTIYNNMFCAGFHEGGRDSCQGDSGGPHVTEVEGTSFLTGIISWGEE
CAMKGKYGIYTKVSRYVNWIKEKTKGAPSPAGSPTSEEGTSESATPESGPGSEPATSGSET
PGTSESATPESGPGTSESATPESGPGTSTEPSEGSAPGTSTEPSEGSAPGASSLTGPEGPSKLTRAETGAGSPG

AETAEQKLISEEDLSPATGHHHHHHHH

SEQ ID NO: 105 K0413_AE144 pNL186
MQRVNMIMAESPGLITICLLGYLLSAECTVFLDHENANKILNRPKRYNSGKLEEFVQGNLER

ECMEEKCSFEEAREVFENTERTTEFWKQYVDGDQCESNPCLNGGSCKDDINSYECWCPFGFE
GKNCELDVTCNIKNGRCEQFCKNSADNKVVCSCTEGYRLAENQKSCEPAVPFPCGRVSVSQT
SKLTRAETVFPDVDYVNSTEAETILDNITQSTQSFNDFTRVVGGEDAKPGQFPWQVVLNGKV
DAFCGGSIVNEKWIVTAAHCVETGVKITVVAGEHNIEETEHTEQKRNVIRIIPHHNYNAAIN
KYNHDIALLELDEPLVLNSYVTPICIADKEYTNIFLKFGSGYVSGWRVFHKGRSALVLQYL
RVPLVDRATCLLSTKFTIYNNMFCAGFHEGGRDSCQGDSGGPHVTEVEGTSFLTGIISWGEE
CAMKGKYGIYTKVSRYVNWIKEKTKGAPSPAGSPTSEEGTSESATPESGPGSEPATSGSET
PGTSESATPESGPGTSTEPSEGSAPGTSTEPSEGSAPGTSTEPSEGSAPGTSTEPSEGSAPG
TSTEPSEGSAPGTSTEPSEGSAPGSPAGSPTSTEEGTSTEPSEGSAPGASSLTGPEGPSKLT

RAETGAGSPGAETAEQKLISEEDLSPATGHHHHHHHH

SEQ ID NO: 106 K0413_AE288 pNL187
MQRVNMIMAESPGLITICLLGYLLSAECTVFLDHENANKILNRPKRYNSGKLEEFVQGNLER

ECMEEKCSFEEAREVFENTERTTEFWKQYVDGDQCESNPCLNGGSCKDDINSYECWCPFGFE
GKNCELDVTCNIKNGRCEQFCKNSADNKVVCSCTEGYRLAENQKSCEPAVPFPCGRVSVSQT
SKLTRAETVFPDVDYVNSTEAETILDNITQSTQSFNDFTRVVGGEDAKPGQFPWQVVLNGKV
DAFCGGSIVNEKWIVTAAHCVETGVKITVVAGEHNIEETEHTEQKRNVIRIIPHHNYNAAIN
KYNHDIALLELDEPLVLNSYVTPICIADKEYTNIFLKFGSGYVSGWRVFHKGRSALVLQYL
RVPLVDRATCLLSTKFTIYNNMFCAGFHEGGRDSCQGDSGGPHVTEVEGTSFLTGIISWGEE
CAMKGKYGIYTKVSRYVNWIKEKTKGAPGTSESATPESGPGSEPATSGSETPGTSESATPES
GPGSEPATSGSETPGTSESATPESGPGTSTEPSEGSAPGSPAGSPTSTEEGTSESATPESGP
GSEPATSGSETPGTSESATPESGPGSPAGSPTSTEEGSPAGSPTSTEEGTSTEPSEGSAPGT
SESATPESGPGTSESATPESGPGTSESATPESGPGSEPATSGSETPGSEPATSGSETPGSPA
GSPTSTEEGTSTEPSEGSAPGTSTEPSEGSAPGSEPATSGSETPGTSESATPESGPGTSTEP
SEGSAPASSLTGPEGPSKLTRAETGAGSPGAETAEQKLISEEDLSPATGHHHHHHHH

SEQ ID NO: 107 A0103_AE72 pNL188
MQRVNMIMAESPGLITICLLGYLLSAECTVFLDHENANKILNRPKRYNSGKLEEFVQGNLER

ECMEEKCSFEEAREVFENTERTTEFWKQYVDGDQCESNPCLNGGSCKDDINSYECWCPFGFE
GKNCELDVTCNIKNGRCEQFCKNSAGAPSPAGSPTSEEGTSESATPESGPGSEPATSGSET
PGTSESATPESGPGTSTEPSEGSAPGTSTEPSEGSAPGASSDNKVVCSCTEGYRLAENQKSC
EPAVPFPCGRVSVSQTSKLTRAETVFPDVDYVNSTEAETILDNITQSTQSFNDFTRVVGGED
AKPGQFPWQVVLNGKVDAFCGGSIVNEKWIVTAAHCVETGVKITVVAGEHNIEETEHTEQKR
NVIRIIPHHNYNAAINKYNHDIALLELDEPLVLNSYVTPICIADKEYTNIFLKFGSGYVSGW
GRVFHKGRSALVLQYLRVPLVDRATCLLSTKFTIYNNMFCAGFHEGGRDSCQGDSGGPHVTE
VEGTSFLTGIISWGEECAMKGKYGIYTKVSRYVNWIKEKTKLTGPEGPSKLTRAETGAGSPG

AETAEQKLISEEDLSPATGHHHHHHHH

SEQ ID NO: 108 A0103_AE144 pNL189
MQRVNMIMAESPGLITICLLGYLLSAECTVFLDHENANKILNRPKRYNSGKLEEFVQGNLER

ECMEEKCSFEEAREVFENTERTTEFWKQYVDGDQCESNPCLNGGSCKDDINSYECWCPFGFE
GKNCELDVTCNIKNGRCEQFCKNSAGAPSPAGSPTSEEGTSESATPESGPGSEPATSGSET
PGTSESATPESGPGTSTEPSEGSAPGTSTEPSEGSAPGTSTEPSEGSAPGTSTEPSEGSAPG
TSTEPSEGSAPGTSTEPSEGSAPGSPAGSPTSTEEGTSTEPSEGSAPGASSDNKVVCSCTEG
YRLAENQKSCEPAVPFPCGRVSVSQTSKLTRAETVFPDVDYVNSTEAETILDNITQSTQSFN
DFTRVVGGEDAKPGQFPWQVVLNGKVDAFCGGSIVNEKWIVTAAHCVETGVKITVVAGEHNI
```

-continued

EETEHTEQKRNVIRIIPHHNYNAAINKYNHDIALLELDEPLVLNSYVTPICIADKEYTNIFL
KFGSGYVSGWRVFHKGRSALVLQYLRVPLVDRATCLLSTKFTIYNNMFCAGFHEGGRDSCQ
GDSGGPHVTEVEGTSFLTGIISWGEECAMKGKYGIYTKVSRYVNWIKEKTKLTGPEGPSKLT
RAETGAGSPGAETAEQKLISEEDLSPATGHHHHHHHH

SEQ ID NO: 109 A0103_AE288 pNL190
MQRVNMIMAESPGLITICLLGYLLSAECTVFLDHENANKILNRPKRYNSGKLEEFVQGNLER
ECMEEKCSFEEAREVFENTERTTEFWKQYVDGDQCESNPCLNGGSCKDDINSYECWCPFGFE
GKNCELDVTCNIKNGRCEQFCKNSA**GAPGTSESATPESGPGSEPATSGSETPGTSESATPES
GPGSEPATSGSETPGTSESATPESGPGTSTEPSEGSAPGSPAGSPTSTEEGTSESATPESGP
GSEPATSGSETPGTSESATPESGPGSPAGSPTSTEEGSPAGSPTSTEEGTSTEPSEGSAPGT
SESATPESGPGTSESATPESGPGTSESATPESGPGSEPATSGSETPGSEPATSGSETPGSPA
GSPTSTEEGTSTEPSEGSAPGTSTEPSEGSAPGSEPATSGSETPGTSESATPESGPGTSTEP
SEGSAPASS**DNKVVCSCTEGYRLAENQKSCEPAVPFPCGRVSVSQTSKLTRAETVFPDVDYV
NSTEAETILDNITQSTQSFNDFTRVVGGEDAKPGQFPWQVVLNGKVDAFCGGSIVNEKWIVT
AAHCVETGVKITVVAGEHNIEETEHTEQKRNVIRIIPHHNYNAAINKYNHDIALLELDEPLV
LNSYVTPICIADKEYTNIFLKFGSGYVSGWRVFHKGRSALVLQYLRVPLVDRATCLLSTKF
TIYNNMFCAGFHEGGRDSCQGDSGGPHVTEVEGTSFLTGIISWGEECAMKGKYGIYTKVSRY
VNWIKEKTKLTGPEGPSKLTRAETGAGSPGAETAEQKLISEEDLSPATGHHHHHHHH

SEQ ID NO: 110 G0226_AE42 pNL195
MQRVNMIMAESPGLITICLLGYLLSAECTVFLDHENANKILNRPKRYNSGKLEEFVQGNLER
ECMEEKCSFEEAREVFENTERTTEFWKQYVDGDQCESNPCLNGGSCKDDINSYECWCPFGFE
GKNCELDVTCNIKNGRCEQFCKNSADNKVVCSCTEGYRLAENQKSCEPAVPFPCGRVSVSQT
SKLTRAETVFPDVDYVNSTEAETILDNITQSTQSFNDFTRVVGGEDAKPGQFPWQVVLNGKV
DAFCGGSIVNEKWIVTAAHCVETG**GAPGSPAGSPTSTEEGTSESATPESGPGSEPATSGSET
PASS**VKITVVAGEHNIEETEHTEQKRNVIRIIPHHNYNAAINKYNHDIALLELDEPLVLNSY
VTPICIADKEYTNIFLKFGSGYVSGWRVFHKGRSALVLQYLRVPLVDRATCLLSTKFTIYN
NMFCAGFHEGGRDSCQGDSGGPHVTEVEGTSFLTGIISWGEECAMKGKYGIYTKVSRYVNWI
KEKTKLTGPEGPSKLTRAETGAGSPGAETAEQKLISEEDLSPATGHHHHHHHH

SEQ ID NO: 111 K0228_AE42 pNL196
MQRVNMIMAESPGLITICLLGYLLSAECTVFLDHENANKILNRPKRYNSGKLEEFVQGNLER
ECMEEKCSFEEAREVFENTERTTEFWKQYVDGDQCESNPCLNGGSCKDDINSYECWCPFGFE
GKNCELDVTCNIKNGRCEQFCKNSADNKVVCSCTEGYRLAENQKSCEPAVPFPCGRVSVSQT
SKLTRAETVFPDVDYVNSTEAETILDNITQSTQSFNDFTRVVGGEDAKPGQFPWQVVLNGKV
DAFCGGSIVNEKWIVTAAHCVETGVK**GAPGSPAGSPTSTEEGSESATPESGPGSEPATSGS
ETPASS**ITVVAGEHNIEETEHTEQKRNVIRIIPHHNYNAAINKYNHDIALLELDEPLVLNSY
VTPICIADKEYTNIFLKFGSGYVSGWRVFHKGRSALVLQYLRVPLVDRATCLLSTKFTIYN
NMFCAGFHEGGRDSCQGDSGGPHVTEVEGTSFLTGIISWGEECAMKGKYGIYTKVSRYVNWI
KEKTKLTGPEGPSKLTRAETGAGSPGAETAEQKLISEEDLSPATGHHHHHHHH

SEQ ID NO: 112 T0230_AE42 pNL197
MQRVNMIMAESPGLITICLLGYLLSAECTVFLDHENANKILNRPKRYNSGKLEEFVQGNLER
ECMEEKCSFEEAREVFENTERTTEFWKQYVDGDQCESNPCLNGGSCKDDINSYECWCPFGFE
GKNCELDVTCNIKNGRCEQFCKNSADNKVVCSCTEGYRLAENQKSCEPAVPFPCGRVSVSQT
SKLTRAETVFPDVDYVNSTEAETILDNITQSTQSFNDFTRVVGGEDAKPGQFPWQVVLNGKV
DAFCGGSIVNEKWIVTAAHCVETGVKIT**GAPGSPAGSPTSTEEGTSESATPESGPGSEPATS
GSETPASS**VVAGEHNIEETEHTEQKRNVIRIIPHHNYNAAINKYNHDIALLELDEPLVLNSY
VTPICIADKEYTNIFLKFGSGYVSGWRVFHKGRSALVLQYLRVPLVDRATCLLSTKFTIYN
NMFCAGFHEGGRDSCQGDSGGPHVTEVEGTSFLTGIISWGEECAMKGKYGIYTKVSRYVNWI
KEKTKLTGPEGPSKLTRAETGAGSPGAETAEQKLISEEDLSPATGHHHHHHHH

SEQ ID NO: 113 N0105_AE42 pNL198
MQRVNMIMAESPGLITICLLGYLLSAECTVFLDHENANKILNRPKRYNSGKLEEFVQGNLER
ECMEEKCSFEEAREVFENTERTTEFWKQYVDGDQCESNPCLNGGSCKDDINSYECWCPFGFE
GKNCELDVTCNIKNGRCEQFCKNSADN**GAPGSPAGSPTSTEEGTSESATPESGPGSEPATSG
SETPASS**KVVCSCTEGYRLAENQKSCEPAVPFPCGRVSVSQTSKLTRAETVFPDVDYVNSTE
AETILDNITQSTQSFNDFTRVVGGEDAKPGQFPWQVVLNGKVDAFCGGSIVNEKWIVTAAHC
VETGVKITVVAGEHNIEETEHTEQKRNVIRIIPHHNYNAAINKYNHDIALLELDEPLVLNSY
VTPICIADKEYTNIFLKFGSGYVSGWRVFHKGRSALVLQYLRVPLVDRATCLLSTKFTIYN
NMFCAGFHEGGRDSCQGDSGGPHVTEVEGTSFLTGIISWGEECAMKGKYGIYTKVSRYVNWI
KEKTKLTGPEGPSKLTRAETGAGSPGAETAEQKLISEEDLSPATGHHHHHHHH

SEQ ID NO: 114 S0283_AE42 pNL199
MQRVNMIMAESPGLITICLLGYLLSAECTVFLDHENANKILNRPKRYNSGKLEEFVQGNLER
ECMEEKCSFEEAREVFENTERTTEFWKQYVDGDQCESNPCLNGGSCKDDINSYECWCPFGFE
GKNCELDVTCNIKNGRCEQFCKNSADNKVVCSCTEGYRLAENQKSCEPAVPFPCGRVSVSQT
SKLTRAETVFPDVDYVNSTEAETILDNITQSTQSFNDFTRVVGGEDAKPGQFPWQVVLNGKV
DAFCGGSIVNEKWIVTAAHCVETGVKITVVAGEHNIEETEHTEQKRNVIRIIPHHNYNAAIN

-continued

KYNHDIALLELDEPLVLNSGAPGSPAGSPTSTEEGTSESATPESGPGSEPATSGSETPASSY
VTPICIADKEYTNIFLKFGSGYVSGWGRVFHKGRSALVLQYLRVPLVDRATCLLSTKFTIYN
NMFCAGFHEGGRDSCQGDSGGPHVTEVEGTSFLTGIISWGEECAMKGKYGIYTKVSRYVNWI
KEKTKLTGPEGPSKLTRAETGAGSPGAETAEQKLISEEDLSPATGHHHHHHHH

SEQ ID NO: 115 CT_AE72 pNL202
MQRVNMIMAESPGLITICLLGYLLSAECTVFLDHENANKILNRPKRYNSGKLEEFVQGNLER

ECMEEKCSFEEAREVFENTERTTEFWKQYVDGDQCESNPCLNGGSCKDDINSYECWCPFGFE
GKNCELDVTCNIKNGRCEQFCKNSADNKVVCSCTEGYRLAENQKSCEPAVPFPCGRVSVSQT
SKLTRAETVFPDVDYVNSTEAETILDNITQSTQSFNDFTRVVGGEDAKPGQFPWQVVLNGKV
DAFCGGSIVNEKWIVTAAHCVETGVKITVVAGEHNIEETEHTEQKRNVIRIIPHHNYNAAIN
KYNHDIALLELDEPLVLNSYVTPICIADKEYTNIFLKFGSGYVSGWGRVFHKGRSALVLQYL
RVPLVDRATCLLSTKFTIYNNMFCAGFHEGGRDSCQGDSGGPHVTEVEGTSFLTGIISWGEE
CAMKGKYGIYTKVSRYVNWIKEKTKLTGAGSPGAETALVPRSFLLRNPNDKYEPFWEDEESG

AGSPGAETAGAPSPAGSPTSTEEGTSESATPESGPGSEPATSGSETPGTSESATPESGPGTS

TEPSEGSAPGTSTEPSEGSAPGASSGAETAEQKLISEEDLSPATGHHHHHHHH

SEQ ID NO: 116 C-term-AE864 FIX-092
MQRVNMIMAESPGLITICLLGYLLSAECTVFLDHENANKILNRPKRYNSGKLEEFVQGNLER ECMEEKCSFEEAREVFENTERTTEFWKQYVDGDQCESNPCLNGGSCKDDINSYECWCPFGFE
GKNCELDVTCNIKNGRCEQFCKNSADNKVVCSCTEGYRLAENQKSCEPAVPFPCGRVSVSQT
SKLTRAETVFPDVDYVNSTEAETILDNITQSTQSFNDFTRVVGGEDAKPGQFPWQVVLNGKV
DAFCGGSIVNEKWIVTAAHCVETGVKITVVAGEHNIEETEHTEQKRNVIRIIPHHNYNAAIN
KYNHDIALLELDEPLVLNSYVTPICIADKEYTNIFLKFGSGYVSGWGRVFHKGRSALVLQYL
RVPLVDRATCLRSTKFTIYNNMFCAGFHEGGRDSCQGDSGGPHVTEVEGTSFLTGIISWGEE
CAMKGKYGIYTKVSRYVNWIKEKTKLTGPEGPSKLTRAETGSPGSPAGSPTSTEEGTSESAT
PESGPGTSTEPSEGSAPGSPAGSPTSTEEGTSTEPSEGSAPGTSTEPSEGSAPGTSESATPE
SGPGSEPATSGSETPGSEPATSGSETPGSPAGSPTSTEEGTSESATPESGPGTSTEPSEGSA
PGTSTEPSEGSAPGSPAGSPTSTEEGTSTEPSEGSAPGTSTEPSEGSAPGTSESATPESGPG
TSTEPSEGSAPGTSESATPESGPGSEPATSGSETPGTSTEPSEGSAPGTSTEPSEGSAPGTS
ESATPESGPGTSESATPESGPGSPAGSPTSTEEGTSESATPESGPGSEPATSGSETPGTSES
ATPESGPGTSTEPSEGSAPGTSTEPSEGSAPGTSTEPSEGSAPGTSTEPSEGSAPGTSTEPS
EGSAPGTSTEPSEGSAPGSPAGSPTSTEEGTSTEPSEGSAPGTSESATPESGPGSEPATSGS
ETPGTSESATPESGPGSEPATSGSETPGTSESATPESGPGTSTEPSEGSAPGTSESATPESG
PGSPAGSPTSTEEGSPAGSPTSTEEGSPAGSPTSTEEGTSESATPESGPGTSTEPSEGSAPG
TSESATPESGPGSEPATSGSETPGTSESATPESGPGSEPATSGSETPGTSESATPESGPGTS
TEPSEGSAPGSPAGSPTSTEEGTSESATPESGPGSEPATSGSETPGTSESATPESGPGSPAG
SPTSTEEGSPAGSPTSTEEGTSTEPSEGSAPGTSESATPESGPGTSESATPESGPGTSESAT
PESGPGSEPATSGSETPGSEPATSGSETPGSPAGSPTSTEEGTSTEPSEGSAPGTSTEPSEG
SAPGSEPATSGSETPGTSESATPESGPGTSTEPSEGSAPGSSS

SEQ ID NO: 117 C-Term-AE144 pJH0131
MQRVNMIMAESPGLITICLLGYLLSAECTVFLDHENANKILNRPKRYNSGKLEEFVQGNLER ECMEEKCSFEEAREVFENTERTTEFWKQYVDGDQCESNPCLNGGSCKDDINSYECWCPFGFE
GKNCELDVTCNIKNGRCEQFCKNSADNKVVCSCTEGYRLAENQKSCEPAVPFPCGRVSVSQT
SKLTRAETVFPDVDYVNSTEAETILDNITQSTQSFNDFTRVVGGEDAKPGQFPWQVVLNGKV
DAFCGGSIVNEKWIVTAAHCVETGVKITVVAGEHNIEETEHTEQKRNVIRIIPHHNYNAAIN
KYNHDIALLELDEPLVLNSYVTPICIADKEYTNIFLKFGSGYVSGWGRVFHKGRSALVLQYL
RVPLVDRATCLLSTKFTIYNNMFCAGFHEGGRDSCQGDSGGPHVTEVEGTSFLTGIISWGEE
CAMKGKYGIYTKVSRYVNWIKEKTKLTGAGSPGAETALVPRSFLLRNPNDKYEPFWEDEESG

AGSPGAETAGAPSPAGSPTSTEEGTSESATPESGPGSEPATSGSETPGTSESATPESGPGTS

TEPSEGSAPGTSTEPSEGSAPGTSTEPSEGSAPGTSTEPSEGSAPGTSTEPSEGSAPGTSTE
PSEGSAPGSPAGSPTSTEEGTSTEPSEGSAPGASS

SEQ ID NO: 118 N105-AE42 pJH44
MQRVNMIMAESPGLITICLLGYLLSAECTVFLDHENANKILNRPKRYNSGKLEEFVQGNLER

ECMEEKCSFEEAREVFENTERTTEFWKQYVDGDQCESNPCLNGGSCKDDINSYECWCPFGFE
GKNCELDVTCNIKNGRCEQFCKNSADNGAPGSPAGSPTSTEEGTSESATPESGPGSEPATSG
SETPASSKVVCSCTEGYRLAENQKSCEPAVPFPCGRVSVSQTSKLTRAETVFPDVDYVNSTE
AETILDNITQSTQSFNDFTRVVGGEDAKPGQFPWQVVLNGKVDAFCGGSIVNEKWIVTAAHC
VETGVKITVVAGEHNIEETEHTEQKRNVIRIIPHHNYNAAINKYNHDIALLELDEPLVLNSY
VTPICIADKEYTNIFLKFGSGYVSGWGRVFHKGRSALVLQYLRVPLVDRATCLLSTKFTIYN
NMFCAGFHEGGRDSCQGDSGGPHVTEVEGTSFLTGIISWGEECAMKGKYGIYTKVSRYVNWI
KEKTKLT

SEQ ID NO: 119 D166-AE72 pJH46
MQRVNMIMAESPGLITICLLGYLLSAECTVFLDHENANKILNRPKRYNSGKLEEFVQGNLER

ECMEEKCSFEEAREVFENTERTTEFWKQYVDGDQCESNPCLNGGSCKDDINSYECWCPFGFE
GKNCELDVTCNIKNGRCEQFCKNSADNKVVCSCTEGYRLAENQKSCEPAVPFPCGRVSVSQT
SKLTRAETVFPDVDYVNSTEAETILDGAPSPAGSPTSTEEGTSESATPESGPGSEPATSGSE
TPGTSESATPESGPGTSTEPSEGSAPGTSTEPSEGSAPGASSNITQSTQSFNDFTRVVGGED

AKPGQFPWQVVLNGKVDAFCGGSIVNEKWIVTAAHCVETGVKITVVAGEHNIEETEHTEQKR
NVIRIIPHHNYNAAINKYNHDIALLELDEPLVLNSYVTPICIADKEYTNIFLKFGSGYVSGW
GRVFHKGRSALVLQYLRVPLVDRATCLLSTKFTIYNNMFCAGFHEGGRDSCQGDSGGPHVTE
VEGTSFLTGIISWGEECAMKGKYGIYTKVSRYVNWIKEKTKLT

SEQ ID NO: 120 D166-AE144 pJH47
MQRVNMIMAESPGLITICLLGYLLSAECTVFLDHENANKILNRPKRYNSGKLEEFVQGNLER

ECMEEKCSFEEAREVFENTERTTEFWKQYVDGDQCESNPCLNGGSCKDDINSYECWCPFGFE
GKNCELDVTCNIKNGRCEQFCKNSADNKVVCSCTEGYRLAENQKSCEPAVPFPCGRVSVSQT
SKLTRAETVFPDVDYVNSTEAETILDGAPSPAGSPTSTEEGTSESATPESGPGSEPATSGSE
TPGTSESATPESGPGTSTEPSEGSAPGTSTEPSEGSAPGTSTEPSEGSAPGTSTEPSEGSAP
GTSTEPSEGSAPGTSTEPSEGSAPGSPAGSPTSTEEGTSTEPSEGSAPGASSNITQSTQSFN
DFTRVVGGEDAKPGQFPWQVVLNGKVDAFCGGSIVNEKWIVTAAHCVETGVKITVVAGEHNI
EETEHTEQKRNVIRIIPHHNYNAAINKYNHDIALLELDEPLVLNSYVTPICIADKEYTNIFL
KFGSGYVSGWGRVFHKGRSALVLQYLRVPLVDRATCLLSTKFTIYNNMFCAGFHEGGRDSCQ
GDSGGPHVTEVEGTSFLTGIISWGEECAMKGKYGIYTKVSRYVNWIKEKTKLT

SEQ ID NO: 121 C-Term-AE144 pJH50
MQRVNMIMAESPGLITICLLGYLLSAECTVFLDHENANKILNRPKRYNSGKLEEFVQGNLER ECMEEKCSFEEAREVFENTERTTEFWKQYVDGDQCESNPCLNGGSCKDDINSYECWCPFGFE
GKNCELDVTCNIKNGRCEQFCKNSADNKVVCSCTEGYRLAENQKSCEPAVPFPCGRVSVSQT
SKLTRAETVFPDVDYVNSTEAETILDNITQSTQSFNDFTRVVGGEDAKPGQFPWQVVLNGKV
DAFCGGSIVNEKWIVTAAHCVETGVKITVVAGEHNIEETEHTEQKRNVIRIIPHHNYNAAIN
KYNHDIALLELDEPLVLNSYVTPICIADKEYTNIFLKFGSGYVSGWGRVFHKGRSALVLQYL
RVPLVDRATCLLSTKFTIYNNMFCAGFHEGGRDSCQGDSGGPHVTEVEGTSFLTGIISWGEE
CAMKGKYGIYTKVSRYVNWIKEKTKLTGAGSPGAETAVPRSFLLRNPNDKYEPFWEDEESG AGSPGAETAGAPTSTEPSEGSAPGTSESATPESGPGTSESATPESGPGTSESATPESGPGSE
PATSGSETPGSEPATSGSETPGSPAGSPTSTEEGTSTEPSEGSAPGTSTEPSEGSAPGSEPA
TSGSETPGTSESATPESGPGTSTEPSEGSAPGASS

SEQ ID NO: 122 C-Term-AE288 pJH51
MQRVNMIMAESPGLITICLLGYLLSAECTVFLDHENANKILNRPKRYNSGKLEEFVQGNLER ECMEEKCSFEEAREVFENTERTTEFWKQYVDGDQCESNPCLNGGSCKDDINSYECWCPFGFE
GKNCELDVTCNIKNGRCEQFCKNSADNKVVCSCTEGYRLAENQKSCEPAVPFPCGRVSVSQT
SKLTRAETVFPDVDYVNSTEAETILDNITQSTQSFNDFTRVVGGEDAKPGQFPWQVVLNGKV
DAFCGGSIVNEKWIVTAAHCVETGVKITVVAGEHNIEETEHTEQKRNVIRIIPHHNYNAAIN
KYNHDIALLELDEPLVLNSYVTPICIADKEYTNIFLKFGSGYVSGWGRVFHKGRSALVLQYL
RVPLVDRATCLLSTKFTIYNNMFCAGFHEGGRDSCQGDSGGPHVTEVEGTSFLTGIISWGEE
CAMKGKYGIYTKVSRYVNWIKEKTKLTGAGSPGAETAVPRSFLLRNPNDKYEPFWEDEESG AGSPGAETAGAPTSTEPSEGSAPGTSESATPESGPGTSESATPESGPGTSESATPESGPGSE
SESATPESGPGTSTEPSEGSAPGSPAGSPTSTEEGTSESATPESGPGSEPATSGSETPGTSE
SATPESGPGSPAGSPTSTEEGSPAGSPTSTEEGTSTEPSEGSAPGTSESATPESGPGTSESA
TPESGPGTSESATPESGPGSEPATSGSETPGSEPATSGSETPGSPAGSPTSTEEGTSTEPSE
GSAPGTSTEPSEGSAPGSEPATSGSETPGTSESATPESGPGTSTEPSEGSAPASS

SEQ ID NO: 123 C-Term-AE72 pJH52
MQRVNMIMAESPGLITICLLGYLLSAECTVFLDHENANKILNRPKRYNSGKLEEFVQGNLER ECMEEKCSFEEAREVFENTERTTEFWKQYVDGDQCESNPCLNGGSCKDDINSYECWCPFGFE
GKNCELDVTCNIKNGRCEQFCKNSADNKVVCSCTEGYRLAENQKSCEPAVPFPCGRVSVSQT
SKLTRAETVFPDVDYVNSTEAETILDNITQSTQSFNDFTRVVGGEDAKPGQFPWQVVLNGKV
DAFCGGSIVNEKWIVTAAHCVETGVKITVVAGEHNIEETEHTEQKRNVIRIIPHHNYNAAIN
KYNHDIALLELDEPLVLNSYVTPICIADKEYTNIFLKFGSGYVSGWGRVFHKGRSALVLQYL
RVPLVDRATCLLSTKFTIYNNMFCAGFHEGGRDSCQGDSGGPHVTEVEGTSFLTGIISWGEE
CAMKGKYGIYTKVSRYVNWIKEKTKLTGAGSPGAETAVPRSFLLRNPNDKYEPFWEDEESG AGSPGAETAGAPTSTEPSEGSAPGTSESATPESGPGTSESATPESGPGTSESATPESGPGSE
ESATPESGPGTSTEPSEGSAPGASS

SEQ ID NO: 124 E224-AE42 pJH54
MQRVNMIMAESPGLITICLLGYLLSAECTVFLDHENANKILNRPKRYNSGKLEEFVQGNLER

ECMEEKCSFEEAREVFENTERTTEFWKQYVDGDQCESNPCLNGGSCKDDINSYECWCPFGFE
GKNCELDVTCNIKNGRCEQFCKNSADNKVVCSCTEGYRLAENQKSCEPAVPFPCGRVSVSQT
SKLTRAETVFPDVDYVNSTEAETILDNITQSTQSFNDFTRVVGGEDAKPGQFPWQVVLNGKV
DAFCGGSIVNEKWIVTAAHCVEGAPGSPAGSPTSTEEGTSESATPESGPGSEPATSGSETPA
SSTGVKITVVAGEHNIEETEHTEQKRNVIRIIPHHNYNAAINKYNHDIALLELDEPLVLNSY
VTPICIADKEYTNIFLKFGSGYVSGWGRVFHKGRSALVLQYLRVPLVDRATCLLSTKFTIYN
NMFCAGFHEGGRDSCQGDSGGPHVTEVEGTSFLTGIISWGEECAMKGKYGIYTKVSRYVNWI
KEKTKLT

SEQ ID NO: 125 D166-AE42 pJH55
MQRVNMIMAESPGLITICLLGYLLSAECTVFLDHENANKILNRPKRYNSGKLEEFVQGNLER
ECMEEKCSFEEAREVFENTERTTEFWKQYVDGDQCESNPCLNGGSCKDDINSYECWCPFGFE
GKNCELDVTCNIKNGRCEQFCKNSADNKVVCSCTEGYRLAENQKSCEPAVPFPCGRVSVSQT
SKLTRAETVFPDVDYVNSTEAETILD**GAPGSPAGSPTSTEEGTSESATPESGPGSEPATSGS
ETPASS**NITQSTQSFNDFTRVVGGEDAKPGQFPWQVVLNGKVDAFCGGSIVNEKWIVTAAHC
VETGVKITVVAGEHNIEETEHTEQKRNVIRIIPHHNYNAAINKYNHDIALLELDEPLVLNSY
VTPICIADKEYTNIFLKFGSGYVSGWGRVFHKGRSALVLQYLRVPLVDRATCLLSTKFTIYN
NMFCAGFHEGGRDSCQGDSGGPHVTEVEGTSFLTGIISWGEECAMKGKYGIYTKVSRYVNWI
KEKTKL

SEQ ID NO: 126 D166-AE42, C-Term-AE72 pJH59
MQRVNMIMAESPGLITICLLGYLLSAECTVFLDHENANKILNRPKRYNSGKLEEFVQGNLER
ECMEEKCSFEEAREVFENTERTTEFWKQYVDGDQCESNPCLNGGSCKDDINSYECWCPFGFE
GKNCELDVTCNIKNGRCEQFCKNSADNKVVCSCTEGYRLAENQKSCEPAVPFPCGRVSVSQT
SKLTRAETVFPDVDYVNSTEAETILD**GAPGSPAGSPTSTEEGTSESATPESGPGSEPATSGS
ETPASS**NITQSTQSFNDFTRVVGGEDAKPGQFPWQVVLNGKVDAFCGGSIVNEKWIVTAAHC
VETGVKITVVAGEHNIEETEHTEQKRNVIRIIPHHNYNAAINKYNHDIALLELDEPLVLNSY
VTPICIADKEYTNIFLKFGSGYVSGWGRVFHKGRSALVLQYLRVPLVDRATCLLSTKFTIYN
NMFCAGFHEGGRDSCQGDSGGPHVTEVEGTSFLTGIISWGEECAMKGKYGIYTKVSRYVNWI
KEKTKLTGAGSPGAETALVPRSFLLRNPNDKYEPFWEDEESGAGSPGAETA**GAPTSESATPE
SGPGSEPATSGSETPGTSESATPESGPGSEPATSGSETPGTSESATPESGPGTSTEPSEGSA
PGAS**

SEQ ID NO: 127 D166-AE42, C-Term-AE144 pJH60
MQRVNMIMAESPGLITICLLGYLLSAECTVFLDHENANKILNRPKRYNSGKLEEFVQGNLER
ECMEEKCSFEEAREVFENTERTTEFWKQYVDGDQCESNPCLNGGSCKDDINSYECWCPFGFE
GKNCELDVTCNIKNGRCEQFCKNSADNKVVCSCTEGYRLAENQKSCEPAVPFPCGRVSVSQT
SKLTRAETVFPDVDYVNSTEAETILD**GAPGSPAGSPTSTEEGTSESATPESGPGSEPATSGS
ETPASS**NITQSTQSFNDFTRVVGGEDAKPGQFPWQVVLNGKVDAFCGGSIVNEKWIVTAAHC
VETGVKITVVAGEHNIEETEHTEQKRNVIRIIPHHNYNAAINKYNHDIALLELDEPLVLNSY
VTPICIADKEYTNIFLKFGSGYVSGWGRVFHKGRSALVLQYLRVPLVDRATCLLSTKFTIYN
NMFCAGFHEGGRDSCQGDSGGPHVTEVEGTSFLTGIISWGEECAMKGKYGIYTKVSRYVNWI
KEKTKLTGAGSPGAETALVPRSFLLRNPNDKYEPFWEDEESGAGSPGAETA**GAPSPAGSPTS
TEEGTSESATPESGPGSEPATSGSETPGTSESATPESGPGTSTEPSEGSAPGTSTEPSEGSA
PGTSTEPSEGSAPGTSTEPSEGSAPGTSTEPSEGSAPGTSTEPSEGSAPGSPAGSPTSTEEG
TSTEPSEGSAPGASS**

SEQ ID NO: 128 D166-AE42, C-Term-AE288 pJH61
MQRVNMIMAESPGLITICLLGYLLSAECTVFLDHENANKILNRPKRYNSGKLEEFVQGNLER
ECMEEKCSFEEAREVFENTERTTEFWKQYVDGDQCESNPCLNGGSCKDDINSYECWCPFGFE
GKNCELDVTCNIKNGRCEQFCKNSADNKVVCSCTEGYRLAENQKSCEPAVPFPCGRVSVSQT
SKLTRAETVFPDVDYVNSTEAETILD**GAPGSPAGSPTSTEEGTSESATPESGPGSEPATSGS
ETPASS**NITQSTQSFNDFTRVVGGEDAKPGQFPWQVVLNGKVDAFCGGSIVNEKWIVTAAHC
VETGVKITVVAGEHNIEETEHTEQKRNVIRIIPHHNYNAAINKYNHDIALLELDEPLVLNSY
VTPICIADKEYTNIFLKFGSGYVSGWGRVFHKGRSALVLQYLRVPLVDRATCLLSTKFTIYN
NMFCAGFHEGGRDSCQGDSGGPHVTEVEGTSFLTGIISWGEECAMKGKYGIYTKVSRYVNWI
KEKTKLTGAGSPGAETALVPRSFLLRNPNDKYEPFWEDEESGAGSPGAETAGAP**GTSESATP
ESGPGSEPATSGSETPGTSESATPESGPGSEPATSGSETPGTSESATPESGPGTSTEPSEGS
APGSPAGSPTSTEEGTSESATPESGPGSEPATSGSETPGTSESATPESGPGSPAGSPTSTEE
GSPAGSPTSTEEGTSTEPSEGSAPGTSESATPESGPGTSESATPESGPGTSESATPESGPGS
EPATSGSETPGSEPATSGSETPGSPAGSPTSTEEGTSTEPSEGSAPGTSTEPSEGSAPGSEP
ATSGSETPGTSESATPESGPGTSTEPSEGSAPASS**

SEQ ID NO: 129 D166-AE72, C-Term-AE72 pJH62
MQRVNMIMAESPGLITICLLGYLLSAECTVFLDHENANKILNRPKRYNSGKLEEFVQGNLER
ECMEEKCSFEEAREVFENTERTTEFWKQYVDGDQCESNPCLNGGSCKDDINSYECWCPFGFE
GKNCELDVTCNIKNGRCEQFCKNSADNKVVCSCTEGYRLAENQKSCEPAVPFPCGRVSVSQT
SKLTRAETVFPDVDYVNSTEAETILD**GAPSPAGSPTSTEEGTSESATPESGPGSEPATSGSE
TPGTSESATPESGPGTSTEPSEGSAPGTSTEPSEGSAPGASS**NITQSTQSFNDFTRVVGGED
AKPGQFPWQVVLNGKVDAFCGGSIVNEKWIVTAAHCVETGVKITVVAGEHNIEETEHTEQKR
NVIRIIPHHNYNAAINKYNHDIALLELDEPLVLNSYVTPICIADKEYTNIFLKFGSGYVSGW
GRVFHKGRSALVLQYLRVPLVDRATCLLSTKFTIYNNMFCAGFHEGGRDSCQGDSGGPHVTE
VEGTSFLTGIISWGEECAMKGKYGIYTKVSRYVNWIKEKTKLTGAGSPGAETA**LVPRSFLLR
NPNDKYEPFWEDEESGAGSPGAETAGAPTSESATPESGPGSEPATSGSETPGTSESATPESG
PGSEPATSGSETPGTSESATPESGPGTSTEPSEGSAPGASS**

SEQ ID NO: 130 D166-AE72, C-Term-AE144 pJH63
MQRVNMIMAESPGLITICLLGYLLSAECTVFLDHENANKILNRPKRYNSGKLEEFVQGNLER
ECMEEKCSFEEAREVFENTERTTEFWKQYVDGDQCESNPCLNGGSCKDDINSYECWCPFGFE
GKNCELDVTCNIKNGRCEQFCKNSADNKVVCSCTEGYRLAENQKSCEPAVPFPCGRVSVSQT

```
SKLTRAETVFPDVDYVNSTEAETILDGAPSPAGSPTSTEEGTSESATPESGPGSEPATSGSE
TPGTSESATPESGPGTSTEPSEGSAPGTSTEPSEGSAPGASSNITQSTQSFNDFTRVVGGED
AKPGQFPWQVVLNGKVDAFCGGSIVNEKWIVTAAHCVETGVKITVVAGEHNIEETEHTEQKR
NVIRIIPHHNYNAAINKYNHDIALLELDEPLVLNSYVTPICIADKEYTNIFLKFGSGYVSGW
GRVFHKGRSALVLQYLRVPLVDRATCLLSTKFTIYNNMFCAGFHEGGRDSCQGDSGGPHVTE
VEGTSFLTGIISWGEECAMKGKYGIYTKVSRYVNWIKEKTKLTGAGSPGAETALVPRSFLLR

NPNDKYEPFWEDEESGAGSPGAETAGAPSPAGSPTSTEEGTSESATPESGPGSEPATSGSET

PGTSESATPESGPGTSTEPSEGSAPGTSTEPSEGSAPGTSTEPSEGSAPGTSTEPSEGSAPG
TSTEPSEGSAPGTSTEPSEGSAPGSPAGSPTSTEEGTSTEPSEGSAPGASS

SEQ ID NO: 131  D166-AE72, C-Term-AE288  pJH64
  MQRVNMIMAESPGLITICLLGYLLSAECTVFLDHENANKILNRPKRYNSGKLEEFVQGNLER ECMEEKCSFEEAREVFENTERTTEFWKQYVDGDQCESNPCLNGGSCKDDINSYECWCPFGFE
GKNCELDVTCNIKNGRCEQFCKNSADNKVVCSCTEGYRLAENQKSCEPAVPFPCGRVSVSQT
SKLTRAETVFPDVDYVNSTEAETILDGAPSPAGSPTSTEEGTSESATPESGPGSEPATSGSE
TPGTSESATPESGPGTSTEPSEGSAPGTSTEPSEGSAPGASSNITQSTQSFNDFTRVVGGED
AKPGQFPWQVVLNGKVDAFCGGSIVNEKWIVTAAHCVETGVKITVVAGEHNIEETEHTEQKR
NVIRIIPHHNYNAAINKYNHDIALLELDEPLVLNSYVTPICIADKEYTNIFLKFGSGYVSGW
GRVFHKGRSALVLQYLRVPLVDRATCLLSTKFTIYNNMFCAGFHEGGRDSCQGDSGGPHVTE
VEGTSFLTGIISWGEECAMKGKYGIYTKVSRYVNWIKEKTKLTGAGSPGAETALVPRSFLLR

NPNDKYEPFWEDEESGAGSPGAETAGAPGTSESATPESGPGSEPATSGSETPGTSESATPES

GPGSEPATSGSETPGTSESATPESGPGTSTEPSEGSAPGSPAGSPTSTEEGTSESATPESGP
GSEPATSGSETPGTSESATPESGPGSPAGSPTSTEEGSPAGSPTSTEEGTSTEPSEGSAPGT
SESATPESGPGTSESATPESGPGTSESATPESGPGSEPATSGSETPGSEPATSGSETPGSPA
GSPTSTEEGTSTEPSEGSAPGTSTEPSEGSAPGSEPATSGSETPGTSESATPESGPGTSTEP
SEGSAPASS

SEQ ID NO: 132  D166-AE144, C-Term-AE72  pJH65
  MQRVNMIMAESPGLITICLLGYLLSAECTVFLDHENANKILNRPKRYNSGKLEEFVQGNLER ECMEEKCSFEEAREVFENTERTTEFWKQYVDGDQCESNPCLNGGSCKDDINSYECWCPFGFE
GKNCELDVTCNIKNGRCEQFCKNSADNKVVCSCTEGYRLAENQKSCEPAVPFPCGRVSVSQT
SKLTRAETVFPDVDYVNSTEAETILDGAPSPAGSPTSTEEGTSESATPESGPGSEPATSGSE
TPGTSESATPESGPGTSTEPSEGSAPGTSTEPSEGSAPGTSTEPSEGSAPGTSTEPSEGSAP
GTSTEPSEGSAPGTSTEPSEGSAPGSPAGSPTSTEEGTSTEPSEGSAPGASSNITQSTQSFN
DFTRVVGGEDAKPGQFPWQVVLNGKVDAFCGGSIVNEKWIVTAAHCVETGVKITVVAGEHNI
EETEHTEQKRNVIRIIPHHNYNAAINKYNHDIALLELDEPLVLNSYVTPICIADKEYTNIFL
KFGSGYVSGWGRVFHKGRSALVLQYLRVPLVDRATCLLSTKFTIYNNMFCAGFHEGGRDSCQ
GDSGGPHVTEVEGTSFLTGIISWGEECAMKGKYGIYTKVSRYVNWIKEKTKLTGAGSPGAET

ALVPRSFLLRNPNDKYEPFWEDEESGAGSPGAETAGAPTSESATPESGPGSEPATSGSETPG

TSESATPESGPGSEPATSGSETPGTSESATPESGPGTSTEPSEGSAPGASS

SEQ ID NO: 133  D166-AE144, C-Term-AE144  pJH66
  MQRVNMIMAESPGLITICLLGYLLSAECTVFLDHENANKILNRPKRYNSGKLEEFVQGNLER ECMEEKCSFEEAREVFENTERTTEFWKQYVDGDQCESNPCLNGGSCKDDINSYECWCPFGFE
GKNCELDVTCNIKNGRCEQFCKNSADNKVVCSCTEGYRLAENQKSCEPAVPFPCGRVSVSQT
SKLTRAETVFPDVDYVNSTEAETILDGAPSPAGSPTSTEEGTSESATPESGPGSEPATSGSE
TPGTSESATPESGPGTSTEPSEGSAPGTSTEPSEGSAPGTSTEPSEGSAPGTSTEPSEGSAP
GTSTEPSEGSAPGTSTEPSEGSAPGSPAGSPTSTEEGTSTEPSEGSAPGASSNITQSTQSFN
DFTRVVGGEDAKPGQFPWQVVLNGKVDAFCGGSIVNEKWIVTAAHCVETGVKITVVAGEHNI
EETEHTEQKRNVIRIIPHHNYNAAINKYNHDIALLELDEPLVLNSYVTPICIADKEYTNIFL
KFGSGYVSGWGRVFHKGRSALVLQYLRVPLVDRATCLLSTKFTIYNNMFCAGFHEGGRDSCQ
GDSGGPHVTEVEGTSFLTGIISWGEECAMKGKYGIYTKVSRYVNWIKEKTKLTGAGSPGAET

ALVPRSFLLRNPNDKYEPFWEDEESGAGSPGAETAGAPSPAGSPTSTEEGTSESATPESGPG

SEPATSGSETPGTSESATPESGPGTSTEPSEGSAPGTSTEPSEGSAPGTSTEPSEGSAPGTS
TEPSEGSAPGTSTEPSEGSAPGTSTEPSEGSAPGSPAGSPTSTEEGTSTEPSEGSAPGASS

SEQ ID NO: 134  D166-AE144, C-Term-AE288  pJH67
  MQRVNMIMAESPGLITICLLGYLLSAECTVFLDHENANKILNRPKRYNSGKLEEFVQGNLER ECMEEKCSFEEAREVFENTERTTEFWKQYVDGDQCESNPCLNGGSCKDDINSYECWCPFGFE
GKNCELDVTCNIKNGRCEQFCKNSADNKVVCSCTEGYRLAENQKSCEPAVPFPCGRVSVSQT
SKLTRAETVFPDVDYVNSTEAETILDGAPSPAGSPTSTEEGTSESATPESGPGSEPATSGSE
TPGTSESATPESGPGTSTEPSEGSAPGTSTEPSEGSAPGTSTEPSEGSAPGTSTEPSEGSAP
GTSTEPSEGSAPGTSTEPSEGSAPGSPAGSPTSTEEGTSTEPSEGSAPGASSNITQSTQSFN
DFTRVVGGEDAKPGQFPWQVVLNGKVDAFCGGSIVNEKWIVTAAHCVETGVKITVVAGEHNI
EETEHTEQKRNVIRIIPHHNYNAAINKYNHDIALLELDEPLVLNSYVTPICIADKEYTNIFL
KFGSGYVSGWGRVFHKGRSALVLQYLRVPLVDRATCLLSTKFTIYNNMFCAGFHEGGRDSCQ
GDSGGPHVTEVEGTSFLTGIISWGEECAMKGKYGIYTKVSRYVNWIKEKTKLTGAGSPGAET

ALVPRSFLLRNPNDKYEPFWEDEESGAGSPGAETAGAPGTSESATPESGPGSEPATSGSETP

GTSESATPESGPGSEPATSGSETPGTSESATPESGPGTSTEPSEGSAPGSPAGSPTSTEEGT
```

-continued

SESATPESGPGSEPATSGSETPGTSESATPESGPGSPAGSPTSTEEGSPAGSPTSTEEGTST
EPSEGSAPGTSESATPESGPGTSESATPESGPGTSESATPESGPGSEPATSGSETPGSEPAT
SGSETPGSPAGSPTSTEEGTSTEPSEGSAPGTSTEPSEGSAPGSEPATSGSETPGTSESATP
ESGPGTSTEPSEGSAPASS

SEQ ID NO: 135 N105-AE42, D166-AE42 pJH68
MQRVNMIMAESPGLITICLLGYLLSAECTVFLDHENANKILNRPKRYNSGKLEEFVQGNLER
ECMEEKCSFEEAREVFENTERTTEFWKQYVDGDQCESNPCLNGGSCKDDINSYECWCPFGFE
GKNCELDVTCNIKNGRCEQFCKNSADN**GAPGSPAGSPTSTEEGTSESATPESGPGSEPATSG
SETPASS**KVVCSCTEGYRLAENQKSCEPAVPFPCGRVSVSQTSKLTRAETVFPDVDYVNSTE
AETILDGAPGSPAGSPTSTEEGTSESATPESGPGSEPATSGSETPASSNITQSTQSFNDFTR
VVGGEDAKPGQFPWQVVLNGKVDAFCGGSIVNEKWIVTAAHCVETGVKITVVAGEHNIEETE
HTEQKRNVIRIIPHHNYNAAINKYNHDIALLELDEPLVLNSYVTPICIADKEYTNIFLKFGS
GYVSGWGRVFHKGRSALVLQYLRVPLVDRATCLLSTKFTIYNNMFCAGFHEGGRDSCQGDSG
GPHVTEVEGTSFLTGIISWGEECAMKGKYGIYTKVSRYVNWIKEKTKLT

SEQ ID NO: 136 N105-AE42, D166-AE72 pJH69
MQRVNMIMAESPGLITICLLGYLLSAECTVFLDHENANKILNRPKRYNSGKLEEFVQGNLER
ECMEEKCSFEEAREVFENTERTTEFWKQYVDGDQCESNPCLNGGSCKDDINSYECWCPFGFE
GKNCELDVTCNIKNGRCEQFCKNSADN**GAPGSPAGSPTSTEEGTSESATPESGPGSEPATSG
SETPASS**KVVCSCTEGYRLAENQKSCEPAVPFPCGRVSVSQTSKLTRAETVFPDVDYVNSTE
AETILD**GAPSPAGSPTSTEEGTSESATPESGPGSEPATSGSETPGTSESATPESGPGTSTEP
SEGSAPGTSTEPSEGSAPGASS**NITQSTQSFNDFTRVVGGEDAKPGQFPWQVVLNGKVDAFC
GGSIVNEKWIVTAAHCVETGVKITVVAGEHNIEETEHTEQKRNVIRIIPHHNYNAAINKYNH
DIALLELDEPLVLNSYVTPICIADKEYTNIFLKFGSGYVSGWGRVFHKGRSALVLQYLRVPL
VDRATCLLSTKFTIYNNMFCAGFHEGGRDSCQGDSGGPHVTEVEGTSFLTGIISWGEECAMK
GKYGIYTKVSRYVNWIKEKTKLT

SEQ ID NO: 137 N105-AE42, D166-AE144 pJH70
MQRVNMIMAESPGLITICLLGYLLSAECTVFLDHENANKILNRPKRYNSGKLEEFVQGNLER
ECMEEKCSFEEAREVFENTERTTEFWKQYVDGDQCESNPCLNGGSCKDDINSYECWCPFGFE
GKNCELDVTCNIKNGRCEQFCKNSADN**GAPGSPAGSPTSTEEGTSESATPESGPGSEPATSG
SETPASS**KVVCSCTEGYRLAENQKSCEPAVPFPCGRVSVSQTSKLTRAETVFPDVDYVNSTE
AETILD**GAPSPAGSPTSTEEGTSESATPESGPGSEPATSGSETPGTSESATPESGPGTSTEP
SEGSAPGTSTEPSEGSAPGTSTEPSEGSAPGTSTEPSEGSAPGTSTEPSEGSAPGTSTEPSE
GSAPGSPAGSPTSTEEGTSTEPSEGSAPGASS**NITQSTQSFNDFTRVVGGEDAKPGQFPWQV
VLNGKVDAFCGGSIVNEKWIVTAAHCVETGVKITVVAGEHNIEETEHTEQKRNVIRIIPHHN
YNAAINKYNHDIALLELDEPLVLNSYVTPICIADKEYTNIFLKFGSGYVSGWGRVFHKGRSA
LVLQYLRVPLVDRATCLLSTKFTIYNNMFCAGFHEGGRDSCQGDSGGPHVTEVEGTSFLTGI
ISWGEECAMKGKYGIYTKVSRYVNWIKEKTKLT

SEQ ID NO: 138 N105-AE42, C-Term-AE72 pJH71
MQRVNMIMAESPGLITICLLGYLLSAECTVFLDHENANKILNRPKRYNSGKLEEFVQGNLER
GNLERECMEEKCSFEEAREVFENTERTTEFWKQYVDGDQCESNPCLNGGSCKDDINSYECWC
PGFEGKNCELDVTCNIKNGRCEQFCKNSADN**GAPGSPAGSPTSTEEGTSESATPESGPGSE
PATSGSETPASS**KVVCSCTEGYRLAENQKSCEPAVPFPCGRVSVSQTSKLTRAETVFPDVDY
VNSTEAETILDNITQSTQSFNDFTRVVGGEDAKPGQFPWQVVLNGKVDAFCGGSIVNEKWIV
TAAHCVETGVKITVVAGEHNIEETEHTEQKRNVIRIIPHHNYNAAINKYNHDIALLELDEPL
VLNSYVTPICIADKEYTNIFLKFGSGYVSGWGRVFHKGRSALVLQYLRVPLVDRATCLLSTK
FTIYNNMFCAGFHEGGRDSCQGDSGGPHVTEVEGTSFLTGIISWGEECAMKGKYGIYTKVSR
YVNWIKEKTKLTGAGSPGAETA*LVPRSFLLRNPNDKYEPFWEDEES*GAGSPGAETAGAP**TSE
SATPESGPGSEPATSGSETPGTSESATPESGPGSEPATSGSETPGTSESATPESGPGTSTEP
SEGSAPGASS**

SEQ ID NO: 139 N105-AE42, C-Term-AE144 pJH72
MQRVNMIMAESPGLITICLLGYLLSAECTVFLDHENANKILNRPKRYNSGKLEEFVQGNLER
ECMEEKCSFEEAREVFENTERTTEFWKQYVDGDQCESNPCLNGGSCKDDINSYECWCPFGFE
GKNCELDVTCNIKNGRCEQFCKNSADN**GAPGSPAGSPTSTEEGTSESATPESGPGSEPATSG
SETPASS**KVVCSCTEGYRLAENQKSCEPAVPFPCGRVSVSQTSKLTRAETVFPDVDYVNSTE
AETILDNITQSTQSFNDFTRVVGGEDAKPGQFPWQVVLNGKVDAFCGGSIVNEKWIVTAAHC
VETGVKITVVAGEHNIEETEHTEQKRNVIRIIPHHNYNAAINKYNHDIALLELDEPLVLNSY
VTPICIADKEYTNIFLKFGSGYVSGWGRVFHKGRSALVLQYLRVPLVDRATCLLSTKFTIYN
NMFCAGFHEGGRDSCQGDSGGPHVTEVEGTSFLTGIISWGEECAMKGKYGIYTKVSRYVNWI
KEKTKLTGAGSPGAETA*LVPRSFLLRNPNDKYEPFWEDEES*GAGSPGAETA**GAPSPAGSPTS
TEEGTSESATPESGPGSEPATSGSETPGTSESATPESGPGTSTEPSEGSAPGTSTEPSEGSA
PGTSTEPSEGSAPGTSTEPSEGSAPGTSTEPSEGSAPGSPAGSPTSTEEG
TSTEPSEGSAPGASS**

SEQ ID NO: 140 N105-AE42, C-Term-AE288 pJH73
MQRVNMIMAESPGLITICLLGYLLSAECTVFLDHENANKILNRPKRYNSGKLEEFVQGNLER
ECMEEKCSFEEAREVFENTERTTEFWKQYVDGDQCESNPCLNGGSCKDDINSYECWCPFGFE
GKNCELDVTCNIKNGRCEQFCKNSADN**GAPGSPAGSPTSTEEGTSESATPESGPGSEPATSG
SETPASS**KVVCSCTEGYRLAENQKSCEPAVPFPCGRVSVSQTSKLTRAETVFPDVDYVNSTE
AETILDNITQSTQSFNDFTRVVGGEDAKPGQFPWQVVLNGKVDAFCGGSIVNEKWIVTAAHC -continued VETGVKITVVAGEHNIEETEHTEQKRNVIRIIPHHNYNAAINKYNHDIALLELDEPLVLNSY
VTPICIADKEYTNIFLKFGSGYVSGWRVFHKGRSALVLQYLRVPLVDRATCLLSTKFTIYN
NMFCAGFHEGGRDSCQGDSGGPHVTEVEGTSFLTGIISWGEECAMKGKYGIYTKVSRYVNWI
KEKTKLTGAGSPGAETA<u>LVPRSFLLRNPNDKYEPFWEDEES</u>GAGSPGAETA**GAPGTSESATP
ESGPGSEPATSGSETPGTSESATPESGPGSEPATSGSETPGTSESATPESGPGTSTEPSEGS
APGSPAGSPTSTEEGTSESATPESGPGSEPATSGSETPGTSESATPESGPGSPAGSPTSTEE
GSPAGSPTSTEEGTSTEPSEGSAPGTSESATPESGPGTSESATPESGPGTSESATPESGPGS
EPATSGSETPGSEPATSGSETPGSPAGSPTSTEEGTSTEPSEGSAPGTSTEPSEGSAPGSEP
ATSGSETPGTSESATPESGPGTSTEPSEGSAPASS**

SEQ ID NO: 141 N105-AE42, E224-AE42 pJH74
<u>MQRVNMIMAESPGLITICLLGYLLSAECTVFLDHENANKILNRPKR</u>YNSGKLEEFVQGNLER

ECMEEKCSFEEAREVFENTERTTEFWKQYVDGDQCESNPCLNGGSCKDDINSYECWCPFGFE
GKNCELDVTCNIKNGRCEQFCKNSADN**GAPGSPAGSPTSTEEGTSESATPESGPGSEPATSG
SETPASS**KVVCSCTEGYRLAENQKSCEPAVPFPCGRVSVSQTSKLTRAETVFPDVDYVNSTE
AETILDNITQSTQSFNDFTRVVGGEDAKPGQFPWQVVLNGKVDAFCGGSIVNEKWIVTAAHC
VEGAPGSPAGSPTSTEEGTSESATPESGPGSEPATSGSETPASSTGVKITVVAGEHNIEETE
HTEQKRNVIRIIPHHNYNAAINKYNHDIALLELDEPLVLNSYVTPICIADKEYTNIFLKFGS
GYVSGWRVFHKGRSALVLQYLRVPLVDRATCLLSTKFTIYNNMFCAGFHEGGRDSCQGDSG
GPHVTEVEGTSFLTGIISWGEECAMKGKYGIYTKVSRYVNWIKEKTKLT

SEQ ID NO: 142 D166-AE42, E224-AE42 pJH75
<u>MQRVNMIMAESPGLITICLLGYLLSAECTVFLDHENANKILNRPKR</u>YNSGKLEEFVQGNLER

ECMEEKCSFEEAREVFENTERTTEFWKQYVDGDQCESNPCLNGGSCKDDINSYECWCPFGFE
GKNCELDVTCNIKNGRCEQFCKNSADNKVVCSCTEGYRLAENQKSCEPAVPFPCGRVSVSQT
SKLTRAETVFPDVDYVNSTEAETILD**GAPGSPAGSPTSTEEGTSESATPESGPGSEPATSGS
ETPASS**NITQSTQSFNDFTRVVGGEDAKPGQFPWQVVLNGKVDAFCGGSIVNEKWIVTAAHC
VEGAPGSPAGSPTSTEEGTSESATPESGPGSEPATSGSETPASSTGVKITVVAGEHNIEETE
HTEQKRNVIRIIPHHNYNAAINKYNHDIALLELDEPLVLNSYVTPICIADKEYTNIFLKFGS
GYVSGWRVFHKGRSALVLQYLRVPLVDRATCLLSTKFTIYNNMFCAGFHEGGRDSCQGDSG
GPHVTEVEGTSFLTGIISWGEECAMKGKYGIYTKVSRYVNWIKEKTKLT

SEQ ID NO: 143 D166-AE72, E224-AE42 pJH76
<u>MQRVNMIMAESPGLITICLLGYLLSAECTVFLDHENANKILNRPKR</u>YNSGKLEEFVQGNLER

ECMEEKCSFEEAREVFENTERTTEFWKQYVDGDQCESNPCLNGGSCKDDINSYECWCPFGFE
GKNCELDVTCNIKNGRCEQFCKNSADNKVVCSCTEGYRLAENQKSCEPAVPFPCGRVSVSQT
SKLTRAETVFPDVDYVNSTEAETILD**GAPSPAGSPTSTEEGTSESATPESGPGSEPATSGSE
TPGTSESATPESGPGTSTEPSEGSAPGTSTEPSEGSAPGASS**NITQSTQSFNDFTRVVGGED
AKPGQFPWQVVLNGKVDAFCGGSIVNEKWIVTAAHCVE**GAPGSPAGSPTSTEEGTSESATPE
SGPGSEPATSGSETPASS**TGVKITVVAGEHNIEETEHTEQKRNVIRIIPHHNYNAAINKYNH
DIALLELDEPLVLNSYVTPICIADKEYTNIFLKFGSGYVSGWRVFHKGRSALVLQYLRVPL
VDRATCLLSTKFTIYNNMFCAGFHEGGRDSCQGDSGGPHVTEVEGTSFLTGIISWGEECAMK
GKYGIYTKVSRYVNWIKEKTKLT

SEQ ID NO: 144 D166-AE144, E224-AE42 pJH77
<u>MQRVNMIMAESPGLITICLLGYLLSAECTVFLDHENANKILNRPKR</u>YNSGKLEEFVQGNLER

MEEKCSFEEAREVFENTERTTEFWKQYVDGDQCESNPCLNGGSCKDDINSYECWCPFGFEGK
NCELDVTCNIKNGRCEQFCKNSADNKVVCSCTEGYRLAENQKSCEPAVPFPCGRVSVSQTSK
LTRAETVFPDVDYVNSTEAETILD**GAPSPAGSPTSTEEGTSESATPESGPGSEPATSGSETP
GTSESATPESGPGTSTEPSEGSAPGTSTEPSEGSAPGTSTEPSEGSAPGTSTEPSEGSAPGT
STEPSEGSAPGTSTEPSEGSAPGSPAGSPTSTEEGTSTEPSEGSAPGASS**NITQSTQSFNDF
TRVVGGEDAKPGQFPWQVVLNGKVDAFCGGSIVNEKWIVTAAHCVE**GAPGSPAGSPTSTEEG
TSESATPESGPGSEPATSGSETPASS**TGVKITVVAGEHNIEETEHTEQKRNVIRIIPHHNYN
AAINKYNHDIALLELDEPLVLNSYVTPICIADKEYTNIFLKFGSGYVSGWRVFHKGRSALV
LQYLRVPLVDRATCLLSTKFTIYNNMFCAGFHEGGRDSCQGDSGGPHVTEVEGTSFLTGIIS
WGEECAMKGKYGIYTKVSRYVNWIKEKTKLT

SEQ ID NO: 145 E224-AE42, C-Term-AE72 pJH78
<u>MQRVNMIMAESPGLITICLLGYLLSAECTVFLDHENANKILNRPKR</u>YNSGKLEEFVQGNLER ECMEEKCSFEEAREVFENTERTTEFWKQYVDGDQCESNPCLNGGSCKDDINSYECWCPFGFE
GKNCELDVTCNIKNGRCEQFCKNSADNKVVCSCTEGYRLAENQKSCEPAVPFPCGRVSVSQT
SKLTRAETVFPDVDYVNSTEAETILDNITQSTQSFNDFTRVVGGEDAKPGQFPWQVVLNGKV
DAFCGGSIVNEKWIVTAAHCVE**GAPGSPAGSPTSTEEGTSESATPESGPGSEPATSGSETPA
SS**TGVKITVVAGEHNIEETEHTEQKRNVIRIIPHHNYNAAINKYNHDIALLELDEPLVLNSY
VTPICIADKEYTNIFLKFGSGYVSGWRVFHKGRSALVLQYLRVPLVDRATCLLSTKFTIYN
NMFCAGFHEGGRDSCQGDSGGPHVTEVEGTSFLTGIISWGEECAMKGKYGIYTKVSRYVNWI
KEKTKLTGAGSPGAETA<u>LVPRSFLLRNPNDKYEPFWEDEES</u>GAGSPGAETAGAP**TSESATPE
SGPGSEPATSGSETPGTSESATPESGPGSEPATSGSETPGTSESATPESGPGTSTEPSEGSA
PGASS**

SEQ ID NO: 146 E224-AE42, C-Term-AE144 pJH79
<u>MQRVNMIMAESPGLITICLLGYLLSAECTVFLDHENANKILNRPKR</u>YNSGKLEEFVQGNLER ECMEEKCSFEEAREVFENTERTTEFWKQYVDGDQCESNPCLNGGSCKDDINSYECWCPFGFE
GKNCELDVTCNIKNGRCEQFCKNSADNKVVCSCTEGYRLAENQKSCEPAVPFPCGRVSVSQT -continued SKLTRAETVFPDVDYVNSTEAETILDNITQSTQSFNDFTRVVGGEDAKPGQFPWQVVLNGKV
DAFCGGSIVNEKWIVTAAHCV**EGAPGSPAGSPTSTEEGTSESATPESGPGSEPATSGSETPA
SST**GVKITVVAGEHNIEETEHTEQKRNVIRIIPHHNYNAAINKYNHDIALLELDEPLVLNSY
VTPICIADKEYTNIFLKFGSGYVSGWRVFHKGRSALVLQYLRVPLVDRATCLLSTKFTIYN
NMFCAGFHEGGRDSCQGDSGGPHVTEVEGTSFLTGIISWGEECAMKGKYGIYTKVSRYVNWI
KEKTKLTGAGSPGAETALVPRSFLLRNPNDKYEPFWEDEESGAGSPGAETA**GAPSPAGSPTS TEEGTSESATPESGPGSEPATSGSETPGTSESATPESGPGTSTEPSEGSAPGTSTEPSEGSA
PGTSTEPSEGSAPGTSTEPSEGSAPGTSTEPSEGSAPGTSTEPSEGSAPGSPAGSPTSTEEG
TSTEPSEGSAPGASS**

SEQ ID NO: 147 E224-AE42, C-Term-AE288 pJH80

MQRVNMIMAESPGLITICLLGYLLSAECTVFLDHENANKILNRPKRYNSGKLEEFVQGNLER

ECMEEKCSFEEAREVFENTERTTEFWKQYVDGDQCESNPCLNGGSCKDDINSYECWCPFGFE
GKNCELDVTCNIKNGRCEQFCKNSADNKVVCSCTEGYRLAENQKSCEPAVPFPCGRVSVSQT
SKLTRAETVFPDVDYVNSTEAETILDNITQSTQSFNDFTRVVGGEDAKPGQFPWQVVLNGKV
DAFCGGSIVNEKWIVTAAHCV**EGAPGSPAGSPTSTEEGTSESATPESGPGSEPATSGSETPA
SST**GVKITVVAGEHNIEETEHTEQKRNVIRIIPHHNYNAAINKYNHDIALLELDEPLVLNSY
VTPICIADKEYTNIFLKFGSGYVSGWRVFHKGRSALVLQYLRVPLVDRATCLLSTKFTIYN
NMFCAGFHEGGRDSCQGDSGGPHVTEVEGTSFLTGIISWGEECAMKGKYGIYTKVSRYVNWI
KEKTKLTGAGSPGAETALVPRSFLLRNPNDKYEPFWEDEESGAGSPGAETA**GAPGTSESATP

ESGPGSEPATSGSETPGTSESATPESGPGSEPATSGSETPGTSESATPESGPGTSTEPSEGS
APGSPAGSPTSTEEGTSESATPESGPGSEPATSGSETPGTSESATPESGPGSPAGSPTSTEE
GSPAGSPTSTEEGTSTEPSEGSAPGTSESATPESGPGTSESATPESGPGTSESATPESGPGS
EPATSGSETPGSEPATSGSETPGSPAGSPTSTEEGTSTEPSEGSAPGTSTEPSEGSAPGSEP
ATSGSETPGTSESATPESGPGTSTEPSEGSAPASS**

SEQ ID NO: 148 N105-AE42, C-Term-Fc pJH81

MQRVNMIMAESPGLITICLLGYLLSAECTVFLDHENANKILNRPKRYNSGKLEEFVQGNLER

ECMEEKCSFEEAREVFENTERTTEFWKQYVDGDQCESNPCLNGGSCKDDINSYECWCPFGFE
GKNCELDVTCNIKNGRCEQFCKNSADN**GAPGSPAGSPTSTEEGTSESATPESGPGSEPATSG
SETPASS**KVVCSCTEGYRLAENQKSCEPAVPFPCGRVSVSQTSKLTRAETVFPDVDYVNSTE
AETILDNITQSTQSFNDFTRVVGGEDAKPGQFPWQVVLNGKVDAFCGGSIVNEKWIVTAAHC
VETGVKITVVAGEHNIEETEHTEQKRNVIRIIPHHNYNAAINKYNHDIALLELDEPLVLNSY
VTPICIADKEYTNIFLKFGSGYVSGWRVFHKGRSALVLQYLRVPLVDRATCLLSTKFTIYN
NMFCAGFHEGGRDSCQGDSGGPHVTEVEGTSFLTGIISWGEECAMKGKYGIYTKVSRYVNWI
KEKTKLTDKTHTCPPCPAPELLGGPSVFLFPPKPKDTLMISRTPEVTCVVVDVSHEDPEVKF
NWYVDGVEVHNAKTKPREEQYNSTYRVVSVLTVLHQDWLNGKEYKCKVSNKALPAPIEKTIS
KAKGQPREPQVYTLPPSRDELTKNQVSLTCLVKGFYPSDIAVEWESNGQPENNYKTTPPVLD
SDGSFFLYSKLTVDKSRWQQGNVFSCSVMHEALHNHYTQKSLSLSPGKGGGGSGGGGSGGGG

SGGGGSDKTHTCPPCPAPELLGGPSVFLFPPKPKDTLMISRTPEVTCVVVDVSHEDPEVKFN**
WYVDGVEVHNAKTKPREEQYNSTYRVVSVLTVLHQDWLNGKEYKCKVSNKALPAPIEKTISK
AKGQPREPQVYTLPPSRDELTKNQVSLTCLVKGFYPSDIAVEWESNGQPENNYKTTPPVLDS
DGSFFLYSKLTVDKSRWQQGNVFSCSVMHEALHNHYTQKSLSLSPGK**

SEQ ID NO: 149 E224-AE42, C-Term-Fc pJH82

MQRVNMIMAESPGLITICLLGYLLSAECTVFLDHENANKILNRPKRYNSGKLEEFVQGNLER

ECMEEKCSFEEAREVFENTERTTEFWKQYVDGDQCESNPCLNGGSCKDDINSYECWCPFGFE
GKNCELDVTCNIKNGRCEQFCKNSADNKVVCSCTEGYRLAENQKSCEPAVPFPCGRVSVSQT
SKLTRAETVFPDVDYVNSTEAETILDNITQSTQSFNDFTRVVGGEDAKPGQFPWQVVLNGKV
DAFCGGSIVNEKWIVTAAHCV**EGAPGSPAGSPTSTEEGTSESATPESGPGSEPATSGSETPA
SST**GVKITVVAGEHNIEETEHTEQKRNVIRIIPHHNYNAAINKYNHDIALLELDEPLVLNSY
VTPICIADKEYTNIFLKFGSGYVSGWRVFHKGRSALVLQYLRVPLVDRATCLLSTKFTIYN
NMFCAGFHEGGRDSCQGDSGGPHVTEVEGTSFLTGIISWGEECAMKGKYGIYTKVSRYVNWI
KEKTKLTDKTHTCPPCPAPELLGGPSVFLFPPKPKDTLMISRTPEVTCVVVDVSHEDPEVKF
NWYVDGVEVHNAKTKPREEQYNSTYRVVSVLTVLHQDWLNGKEYKCKVSNKALPAPIEKTIS
KAKGQPREPQVYTLPPSRDELTKNQVSLTCLVKGFYPSDIAVEWESNGQPENNYKTTPPVLD
SDGSFFLYSKLTVDKSRWQQGNVFSCSVMHEALHNHYTQKSLSLSPGKGGGGSGGGGSGGGG

SGGGGSDKTHTCPPCPAPELLGGPSVFLFPPKPKDTLMISRTPEVTCVVVDVSHEDPEVKFN**
WYVDGVEVHNAKTKPREEQYNSTYRVVSVLTVLHQDWLNGKEYKCKVSNKALPAPIEKTISK
AKGQPREPQVYTLPPSRDELTKNQVSLTCLVKGFYPSDIAVEWESNGQPENNYKTTPPVLDS
DGSFFLYSKLTVDKSRWQQGNVFSCSVMHEALHNHYTQKSLSLSPGK**

SEQ ID NO: 150 D166-AE42, C-Term-Fc pJH83

MQRVNMIMAESPGLITICLLGYLLSAECTVFLDHENANKILNRPKRYNSGKLEEFVQGNLER

ECMEEKCSFEEAREVFENTERTTEFWKQYVDGDQCESNPCLNGGSCKDDINSYECWCPFGFE
GKNCELDVTCNIKNGRCEQFCKNSADNKVVCSCTEGYRLAENQKSCEPAVPFPCGRVSVSQT
SKLTRAETVFPDVDYVNSTEAETILD**GAPGSPAGSPTSTEEGTSESATPESGPGSEPATSGS
ETPASS**NITQSTQSFNDFTRVVGGEDAKPGQFPWQVVLNGKVDAFCGGSIVNEKWIVTAAHC
VETGVKITVVAGEHNIEETEHTEQKRNVIRIIPHHNYNAAINKYNHDIALLELDEPLVLNSY
VTPICIADKEYTNIFLKFGSGYVSGWRVFHKGRSALVLQYLRVPLVDRATCLLSTKFTIN
NMFCAGFHEGGRDSCQGDSGGPHVTEVEGTSFLTGIISWGEECAMKGKYGIYTKVSRYVNWI
KEKTKLTDKTHTCPPCPAPELLGGPSVFLFPPKPKDTLMISRTPEVTCVVVDVSHEDPEVKF

-continued

NWYVDGVEVHNAKTKPREEQYNSTYRVVSVLTVLHQDWLNGKEYKCKVSNKALPAPIEKTIS
KAKGQPREPQVYTLPPSRDELTKNQVSLTCLVKGFYPSDIAVEWESNGQPENNYKTTPPVLD
SDGSFFLYSKLTVDKSRWQQGNVFSCSVMHEALHNHYTQKSLSLSPGKGGGGSGGGGSGGGG

SGGGGSDKTHTCPPCPAPELLGGPSVFLFPPKPKDTLMISRTPEVTCVVVDVSHEDPEVKFN

WYVDGVEVHNAKTKPREEQYNSTYRVVSVLTVLHQDWLNGKEYKCKVSNKALPAPIEKTISK
AKGQPREPQVYTLPPSRDELTKNQVSLTCLVKGFYPSDIAVEWESNGQPENNYKTTPPVLDS
DGSFFLYSKLTVDKSRWQQGNVFSCSVMHEALHNHYTQKSLSLSPGK

SEQ ID NO: 151 D166-AE72, C-Term-Fc pJH84
MQRVNMIMAESPGLITICLLGYLLSAECTVFLDHENANKILNRPKRYNSGKLEEFVQGNLER
ECMEEKCSFEEAREVFENTERTTEFWKQYVDGDQCESNPCLNGGSCKDDINSYECWCPFGFE
GKNCELDVTCNIKNGRCEQFCKNSADNKVVCSCTEGYRLAENQKSCEPAVPFPCGRVSVSQT
SKLTRAETVFPDVDYVNSTEAETILDGAPSPAGSPTSTEEGTSESATPESGPGSEPATSGSE
TPGTSESATPESGPGTSTEPSEGSAPGTSTEPSEGSAPGASSNITQSTQSFNDFTRVVGGED
AKPGQFPWQVVLNGKVDAFCGGSIVNEKWIVTAAHCVETGVKITVVAGEHNIEETEHTEQKR
NVIRIIPHHNYNAAINKYNHDIALLELDEPLVLNSYVTPICIADKEYTNIFLKFGSGYVSGW
GRVFHKGRSALVLQYLRVPLVDRATCLLSTKFTIYNNMFCAGFHEGGRDSCQGDSGGPHVTE
VEGTSFLTGIISWGEECAMKGKYGIYTKVSRYVNWIKEKTKLTDKTHTCPPCPAPELLGGPS
VFLFPPKPKDTLMISRTPEVTCVVVDVSHEDPEVKFNWYVDGVEVHNAKTKPREEQYNSTYR
VVSVLTVLHQDWLNGKEYKCKVSNKALPAPIEKTISKAKGQPREPQVYTLPPSRDELTKNQV
SLTCLVKGFYPSDIAVEWESNGQPENNYKTTPPVLDSDGSFFLYSKLTVDKSRWQQGNVFSC
SVMHEALHNHYTQKSLSLSPGKGGGGSGGGGSGGGGSGGGGSDKTHTCPPCPAPELLGGPSV FLFPPKPKDTLMISRTPEVTCVVVDVSHEDPEVKFNWYVDGVEVHNAKTKPREEQYNSTYRV
VSVLTVLHQDWLNGKEYKCKVSNKALPAPIEKTISKAKGQPREPQVYTLPPSRDELTKNQVS
LTCLVKGFYPSDIAVEWESNGQPENNYKTTPPVLDSDGSFFLYSKLTVDKSRWQQGNVFSCS
VMHEALHNHYTQKSLSLSPGK SEQ ID NO: 152 D166-AE144, C-Term-Fc pJH85
MQRVNMIMAESPGLITICLLGYLLSAECTVFLDHENANKILNRPKRYNSGKLEEFVQGNLER
GNLERECMEEKCSFEEAREVFENTERTTEFWKQYVDGDQCESNPCLNGGSCKDDINSYECWC
PFGFEGKNCELDVTCNIKNGRCEQFCKNSADNKVVCSCTEGYRLAENQKSCEPAVPFPCGRV
SVSQTSKLTRAETVFPDVDYVNSTEAETILDGAPSPAGSPTSTEEGTSESATPESGPGSEPA
TSGSETPGTSESATPESGPGTSTEPSEGSAPGTSTEPSEGSAPGTSTEPSEGSAPGTSTEPS
EGSAPGTSTEPSEGSAPGTSTEPSEGSAPGSPAGSPTSTEEGTSTEPSEGSAPGASSNITQS
TQSFNDFTRVVGGEDAKPGQFPWQVVLNGKVDAFCGGSIVNEKWIVTAAHCVETGVKITVVA
GEHNIEETEHTEQKRNVIRIIPHHNYNAAINKYNHDIALLELDEPLVLNSYVTPICIADKEY
TNIFLKFGSGYVSGWGRVFHKGRSALVLQYLRVPLVDRATCLLSTKFTIYNNMFCAGFHEGG
RDSCQGDSGGPHVTEVEGTSFLTGIISWGEECAMKGKYGIYTKVSRYVNWIKEKTKLTDKTH
TCPPCPAPELLGGPSVFLFPPKPKDTLMISRTPEVTCVVVDVSHEDPEVKFNWYVDGVEVHN
AKTKPREEQYNSTYRVVSVLTVLHQDWLNGKEYKCKVSNKALPAPIEKTISKAKGQPREPQV
YTLPPSRDELTKNQVSLTCLVKGFYPSDIAVEWESNGQPENNYKTTPPVLDSDGSFFLYSKL
TVDKSRWQQGNVFSCSVMHEALHNHYTQKSLSLSPGKGGGGSGGGGSGGGGSGGGGSDKTHT CPPCPAPELLGGPSVFLFPPKPKDTLMISRTPEVTCVVVDVSHEDPEVKFNWYVDGVEVHNA
KTKPREEQYNSTYRVVSVLTVLHQDWLNGKEYKCKVSNKALPAPIEKTISKAKGQPREPQVY
TLPPSRDELTKNQVSLTCLVKGFYPSDIAVEWESNGQ SEQ ID NO: 153 C-Term-Fc pJH56
MQRVNMIMAESPGLITICLLGYLLSAECTVFLDHENANKILNRPKRYNSGKLEEFVQGNLER
ECMEEKCSFEEAREVFENTERTTEFWKQYVDGDQCESNPCLNGGSCKDDINSYECWCPFGFE
GKNCELDVTCNIKNGRCEQFCKNSADNKVVCSCTEGYRLAENQKSCEPAVPFPCGRVSVSQT
SKLTRAETVFPDVDYVNSTEAETILDNITQSTQSFNDFTRVVGGEDAKPGQFPWQVVLNGKV
DAFCGGSIVNEKWIVTAAHCVETGVKITVVAGEHNIEETEHTEQKRNVIRIIPHHNYNAAIN
KYNHDIALLELDEPLVLNSYVTPICIADKEYTNIFLKFGSGYVSGWGRVFHKGRSALVLQYL
RVPLVDRATCLLSTKFTIYNNMFCAGFHEGGRDSCQGDSGGPHVTEVEGTSFLTGIISWGEE
CAMKGKYGIYTKVSRYVNWIKEKTKLTDKTHTCPPCPAPELLGGPSVFLFPPKPKDTLMISR
TPEVTCVVVDVSHEDPEVKFNWYVDGVEVHNAKTKPREEQYNSTYRVVSVLTVLHQDWLNGK
EYKCKVSNKALPAPIEKTISKAKGQPREPQVYTLPPSRDELTKNQVSLTCLVKGFYPSDIAV
EWESNGQPENNYKTTPPVLDSDGSFFLYSKLTVDKSRWQQGNVFSCSVMHEALHNHYTQKSL
SLSPGKGGGGSGGGGSGGGGSGGGGSDKTHTCPPCPAPELLGGPSVFLFPPKPKDTLMISRT PEVTCVVVDVSHEDPEVKFNWYVDGVEVHNAKTKPREEQYNSTYRVVSVLTVLHQDWLNGKE
YKCKVSNKALPAPIEKTISKAKGQPREPQVYTLPPSRDELTKNQVSLTCLVKGFYPSDIAVE
WESNGQPENNYKTTPPVLDSDGSFFLYSKLTVDKSRWQQGNVFSCSVMHEALHNHYTQKSLS
LSPGK SEQ ID NO: 226 C-Term-AE288 pSYN-FIX-102
MQRVNMIMAESPGLITICLLGYLLSAECTVFLDHENANKILNRPKRYNSGKLEEFVQGNLER
EVFENTERTTEFWKQYVDGDQCESNPCLNGGSCKDDINSYECWCPFGFEGKNCELDVTCNIKNGRCEQFCKNSAD
NKVVCSCTEGYRLAENQKSCEPAVPFPCGRVSVSQTSKLTRAETVFPDVDYVNSTEAETILDNITQSTQSFNDFT
RVVGGEDAKPGQFPWQVVLNGKVDAFCGGSIVNEKWIVTAAHCVETGVKITVVAGEHNIEETEHTEQKRNVIRII
PHHNYNAAINKYNHDIALLELDEPLVLNSYVTPICIADKEYTNIFLKFGSGYVSGWGRVFHKGRSALVLQYLRVP
LVDRATCLLSTKFTIYNNMFCAGFHEGGRDSCQGDSGGPHVTEVEGTSFLTGIISWGEECAMKGKYGIYTKVSRY -continued

```
VNWIKEKTKLTGPEGPSKLTRAETGAGSPGAETAGTSESATPESGPGSEPATSGSETPGTSESATPESGPGSEPA
TSGSETPGTSESATPESGPGTSTEPSEGSAPGSPAGSPTSTEEGTSESATPESGPGSEPATSGSETPGTSESATP
ESGPGSPAGSPTSTEEGSPAGSPTSTEEGTSTEPSEGSAPGTSESATPESGPGTSESATPESGPGTSESATPESG
PGSEPATSGSETPGSEPATSGSETPGSPAGSPTSTEEGTSTEPSEGSAPGTSTEPSEGSAPGSEPATSGSETPGT
SESATPESGPGTSTEPSEGSAPGAETAEQKLISEEDLSPATGHHHHHH*

SEQ ID NO: 227 dual chain D166-AE72, C-Term-Fc pSYN-FIX-216
MQRVNMIMAESPGLITICLLGYLLSAECTVFLDHENANKILNRPKRYNSGKLEEFVQGNLER
EVFENTERTTEFWKQYVDGDQCESNPCLNGGSCKDDINSYECWCPFGFEGKNCELDVTCNIKNGRCEQFCKNSAD
NKVVCSCTEGYRLAENQKSCEPAVPFPCGRVSVSQTSKLTRAETVFPDVDYVNSTEAETILDGPSPGSPTSTEEG
TSESATPESGPGSEPATSGSETPGTSESATPESGPGTSTEPSEGSAPGTSTEPSEGSAPGASSNITQSTQSFNDF
TRVVGGEDAKPGQFPWQVVLNGKVDAFCGGSIVNEKWIVTAAHCVETGVKITVVAGEHNIEETEHTEQKRNVIRI
IPHHNYNAAINKYNHDIALLELDEPLVLNSYVTPICIADKEYTNIFLKFGSGYVSGWGRVFHKGRSALVLQYLRV
PLVDRATCLLSTKFTIYNNMFCAGFHEGGRDSCQGDSGGPHVTEVEGTSFLTGIISWGEECAMKGKYGIYTKVSR
YVNWIKEKTKLTDKTHTCPPCPAPELLGGPSVFLFPPKPKDTLMISRTPEVTCVVVDVSHEDPEVKFNWYVDGVE
VHNAKTKPREEQYNSTYRVVSVLTVLHQDWLNGKEYKCKVSNKALPAPIEKTISKAKGQPREPQVYTLPPSRDEL
TKNQVSLTCLVKGFYPSDIAVEWESNGQPENNYKTTPPVLDSDGSFFLYSKLTVDKSRWQQGNVFSCSVMHEALH
NHYTQKSLSLSPG SEQ ID NO: 228 dual chain D166-AE72, C-Term-Fc pSYN-FIX-216-Fc
chain part
DKTHTCPPCPAPELLGGPSVFLFPPKPKDTLMISRTPEVTCVVVDVSHEDPEVKFNWYVDGVEVHNAKTKPREEQ
YNSTYRVVSVLTVLHQDWLNGKEYKCKVSNKALPAPIEKTISKAKGQPREPQVYTLPPSRDELTKNQVSLTCLVK
GFYPSDIAVEWESNGQPENNYKTTPPVLDSDGSFFLYSKLTVDKSRWQQGNVFSCSVMHEALHNHYTQKSLSLSP
G
```

Key:
Signal peptide (pre-peptide)
Pro-peptide
Linker with or without protein tag
*Cleavage site*
Insertion or fusion of XTEN and/or Fc

SEQUENCE LISTING (228 sequences)

SEQ ID NO: 1 - protein, 415 aa, Artificial Sequence
  Human FIX polypeptide
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 2 - protein, 415 aa, Artificial Sequence
  Padua FIX Polypeptide
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLLSTKFTIYNNMFCAGFHEGGRDSCQGDSGGPHVTEVEGTSFLTGIISWGEECAMKGKYGIYTKVSRYVNWIKEKTKLT

SEQ ID NO: 3 - protein, 46 aa, Artificial Sequence
  Human FIX Signal Polypeptide and Propeptide
MQRVNMIMAESPGLITICLLGYLLSAECTVFLDHENANKILNRPKR

SEQ ID NO: 4 - protein, 12 aa, Artificial Sequence
  Synthetic FIX-XTEN Fusion Protein  AD MOTIF
GESPGGSSGSES

SEQ ID NO: 5 - protein, 12 aa, Artificial Sequence
  Synthetic FIX-XTEN Fusion Protein  AD Motif
GSEGSSGPGESS

SEQ ID NO: 6 - protein, 12 aa, Artificial Sequence
  Synthetic FIX-XTEN Fusion Protein AD MOTIF
GSSESGSSEGGP

SEQ ID NO: 7 - protein, 12 aa, Artificial Sequence
  Synthetic XTEN AD MOTIF
GSGGEPSESGSS

SEQ ID NO: 8 - protein, 12 aa, Artificial Sequence
  Synthetic FIX-XTEN Fusion Protein  AE, AM MOTIF
GSPAGSPTSTEE

SEQ ID NO: 9 - protein, 12 aa, Artificial Sequence
  Synthetic XTEN  AE, AM, AQ MOTIF
GSEPATSGSETP

SEQ ID NO: 10 - protein, 12 aa, Artificial Sequence
  Synthetic XTEN AE, AM, AQ MOTIF
GTSESATPESGP

SEQ ID NO: 11 - protein, 12 aa, Artificial Sequence
  Synthetic XTEN AE, AM, AQ MOTIF
GTSTEPSEGSAP

SEQ ID NO: 12 - protein, 12 aa, Artificial Sequence
  Synthetic XTEN AF, AM MOTIF
GSTSESPSGTAP

SEQ ID NO: 13 - protein, 12 aa, Artificial Sequence
  Synthetic XTEN AF, AM MOTIF
GTSTPESGSASP

SEQ ID NO: 14 - protein, 12 aa, Artificial Sequence
  Synthetic XTEN AF, AM MOTIF
GTSPSGESSTAP

SEQ ID NO: 15 - protein, 12 aa, Artificial Sequence
  Synthetic XTEN AF, AM MOTIF
GSTSSTAESPGP

SEQ ID NO: 16 - protein, 12 aa, Artificial Sequence
  Synthetic XTEN AG, AM MOTIF
GTPGSGTASSSP

SEQ ID NO: 17 - protein, 12 aa, Artificial Sequence
  Synthetic XTEN AG, AM MOTIF
GSSTPSGATGSP

SEQ ID NO: 18 - protein, 12 aa, Artificial Sequence
  Synthetic XTEN AG, AM MOTIF
GSSPSASTGTGP

SEQ ID NO: 19 - protein, 12 aa, Artificial Sequence
  Synthetic XTEN AG, AM MOTIF
GASPGTSSTGSP

SEQ ID NO: 20 - protein, 12 aa, Artificial Sequence
  Synthetic XTEN AQ MOTIF
GEPAGSPTSTSE

SEQ ID NO: 21 - protein, 12 aa, Artificial Sequence
  Synthetic XTEN AQ MOTIF
GTGEPSSTPASE

SEQ ID NO: 22 - protein, 12 aa, Artificial Sequence
  Synthetic XTEN AQ MOTIF
GSGPSTESAPTE

SEQ ID NO: 23 - protein, 12 aa, Artificial Sequence
  Synthetic XTEN AQ MOTIF
GSETPSGPSETA

SEQ ID NO: 24 - protein, 12 aa, Artificial Sequence
  Synthetic XTEN AQ MOTIF
GPSETSTSEPGA

SEQ ID NO: 25 - protein, 12 aa, Artificial Sequence
  Synthetic XTEN AQ MOTIF
GSPSEPTEGTSA

SEQ ID NO: 26 - protein, 12 aa, Artificial Sequence
  Synthetic XTEN BC MOTIF
GSGASEPTSTEP

SEQ ID NO: 27 - protein, 12 aa, Artificial Sequence
  Synthetic XTEN BC MOTIF
GSEPATSGTEPS

SEQ ID NO: 28 - protein, 12 aa, Artificial Sequence
  Synthetic XTEN BC MOTIF
GTSEPSTSEPGA

SEQ ID NO: 29 - protein, 12 aa, Artificial Sequence
  Synthetic XTEN BC MOTIF
GTSTEPSEPGSA

SEQ ID NO: 30 - protein, 12 aa, Artificial Sequence
  Synthetic XTEN BD MOTIF
GSTAGSETSTEA

SEQ ID NO: 31 - protein, 12 aa, Artificial Sequence
  Synthetic XTEN BD MOTIF
GSETATSGSETA

SEQ ID NO: 32 - protein, 12 aa, Artificial Sequence
  Synthetic XTEN BD MOTIF
GTSESATSESGA

SEQ ID NO: 33 - protein, 12 aa, Artificial Sequence
  Synthetic XTEN BD MOTIF
GTSTEASEGSAS

SEQ ID NO: 34 - protein, 42 aa, Artificial Sequence
  Synthetic XTEN AE42 MOTIF
GAPGSPAGSPTSTEEGTSESATPESGPGSEPATSGSETPASS

SEQ ID NO: 35 - protein, 78 aa, Artificial Sequence
  Synthetic XTEN AE72 MOTIF
GAPTSESATPESGPGSEPATSGSETPGTSESATPESGPGSEPATSGSETPGTSESATPESGPGTSTEPSEGSAPGASS

SEQ ID NO: 36 - protein, 144 aa, Artificial Sequence
  Synthetic XTEN AE144 MOTIF
GSEPATSGSETPGTSESATPESGPGSEPATSGSETPGSPAGSPTSTEEGTSTEPSEGSAPGSEPATSGSETPGSEPATSGSETPGSEPATSGSETPGTSTEPSEGSAPGTSESATPESGPGSEPATSGSETPGTSTEPSEGSAP

SEQ ID NO: 37 - protein, 144 aa, Artificial Sequence
  Synthetic XTEN AE144_2A MOTIF
TSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPG

SEQ ID NO: 38 - protein, 144 aa, Artificial Sequence
  Synthetic XTEN AE144_3B MOTIF
SPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPG

SEQ ID NO: 39 - protein, 144 aa, Artificial Sequence
  Synthetic XTEN AE144_4A MOTIF
TSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPG

SEQ ID NO: 40 - protein, 144 aa, Artificial Sequence
  Synthetic XTEN AE144_5A MOTIF
TSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEG

SEQ ID NO: 41 - protein, 144 aa, Artificial Sequence
  Synthetic XTEN AE144_6B MOTIF
TSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAPG

SEQ ID NO: 42 - protein, 144 aa, Artificial Sequence
  Synthetic XTEN AG144 MOTIF
GTPGSGTASSSPGSSTPSGATGSPGSSPSASTGTGPGSSPSASTGTGPGASPGTSSTGSPGASPGTSSTGSPGSSTPSGATGSPGSSPSASTGTGPGASPGTSSTGSPGSSPSASTGTGPGTPGSGTASSSPGSSTPSGATGSP

SEQ ID NO: 43 - protein, 144 aa, Artificial Sequence
  Synthetic XTEN AG144_A MOTIF
GASPGTSSTGSPGSSPSASTGTGPGSSPSASTGTGPGTPGSGTASSSPGSSTPSGATGSPGSSPSASTGTGPGASPGTSSTGSPGTPGSGTASSSPGSSTPSGATGSPGTPGSGTASSSPGASPGTSSTGSPGASPGTSSTGSP

SEQ ID NO: 44 - protein, 144 aa, Artificial Sequence
  Synthetic XTEN AG144_B MOTIF
GTPGSGTASSSPGSSTPSGATGSPGASPGTSSTGSPGTPGSGTASSSPGSSTPSGATGSPGSSPSASTGTGPGSSPSASTGTGPGSSTPSGATGSPGSSTPSGATGSPGASPGTSSTGSPGASPGTSSTGSPGASPGTSSTGSP

SEQ ID NO: 45 - protein, 144 aa, Artificial Sequence
  Synthetic XTEN AG144_C MOTIF
GTPGSGTASSSPGASPGTSSTGSPGASPGTSSTGSPGASPGTSSTGSPGSSPSASTGTGPGTPGSGTASSSPGASPGTSSTGSPGASPGTSSTGSPGASPGTSSTGSPGSSTPSGATGSPGSSTPSGATGSPGASPGTSSTGSP

SEQ ID NO: 46 - protein, 144 aa, Artificial Sequence
  Synthetic XTEN AG144_F MOTIF
GSSPSASTGTGPGSSPSASTGTGPGASPGTSSTGSPGASPGTSSTGSPGSSTPSGATGSPGSSPSASTGTGPGASPGTSSTGSPGSSPSASTGTGPGTPGSGTASSSPGSSTPSGATGSPGSSTPSGATGSPGASPGTSSTGSP

SEQ ID NO: 47 - protein, 288 aa, Artificial Sequence
  Synthetic XTEN AE288 MOTIF
GTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAP

SEQ ID NO: 48 - protein, 288 aa, Artificial Sequence
  Synthetic XTEN AE288_2 MOTIF
GSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAP

SEQ ID NO: 49 - protein, 288 aa, Artificial Sequence
  Synthetic XTEN AG288 MOTIF
PGASPGTSSTGSPGASPGTSSTGSPGTPGSGTASSSPGSSTPSGATGSPGTPGSGTASSSPGSSTPSGATGSPGTPGSGTASSSPGSSTPSGATGSPGSSTPSGATGSPGSSPSASTGTGPGSSPSASTGTGPGASPGTSSTGSPGTPGSGTASSSPGSSTPSGATGSPGSSPSASTGTGPGSSPSASTGTGPGASPGTSSTGSPGASPGTSSTGSPGSSTPSGATGSPGSSPSASTGTGPGASPGTSSTGSPGSSPSASTGTGPGTPGSGTASSSPGSSTPSGATGS

SEQ ID NO: 50 - protein, 576 aa, Artificial Sequence
  Synthetic XTEN AE576 MOTIF
GSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAP

SEQ ID NO: 51 - protein, 576 aa, Artificial Sequence
  Synthetic XTEN AG576 MOTIF
PGTPGSGTASSSPGSSTPSGATGSPGSSPSASTGTGPGSSPSASTGTGPGSSTPSGATGSPGSSTPSGATGSPGASPGTSSTGSPGASPGTSSTGSPGASPGTSSTGSPGTPGSGTASSSPGASPGTSSTGSPGASPGTSSTGSPGASPGTSSTGSPGSSPSASTGTGPGTPGSGTASSSPGASPGTSSTGSPGASPGTSSTGSPGASPGTSSTGSPGSSTPSGATGSPGSSTPSGATGSPGASPGTSSTGSPGTPGSGTASSSPGSSTPSGATGSPGSSTPSGATGSPGSSTPSGATGSPGSSPSASTGTGPGASPGTSSTGSPGASPGTSSTGSPGTPGSGTASSSPGASPGTSSTGSPGASPGTSSTGSPGASPGTSSTGSPGASPGTSSTGSPGTPGSGTASSSPGSSTPSGATGSPGTPGSGTASSSPGSSTPSGATGSPGTPGSGTASSSPGSSTPSGATGSPGSSTPSGATGSPGSSPSASTGTGPGSSPSASTGTGPGASPGTSSTGSPGTPGSGTASSSPGSSTPSGATGSPGSSPSASTGTGPGSSPSASTGTGPGASPGTSSTGS

SEQ ID NO: 52 - protein, 864 aa, Artificial Sequence
  Synthetic XTEN AE864 MOTIF
GSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAP

SEQ ID NO: 53 - protein, 864 aa, Artificial Sequence
  Synthetic XTEN AG864 MOTIF
GASPGTSSTGSPGSSPSASTGTGPGSSPSASTGTGPGTPGSGTASSSPGSSTPSGATGSPGSSPSASTGTGPGASPGTSSTGSPGTPGSGTASSSPGSSTPSGATGSPGTPGSGTASSSPGASPGTSSTGSPGASPGTSSTGSPGTPGSGTASSSPGSSTPSGATGSPGASPGTSSTGSPGTPGSGTASSSPGSSTPSGATGSPGSSPSASTGTGPGSSPSASTGTGPGSSTPSGATGSPGSSTPSGATGSPGASPGTSSTGSPGASPGTSSTGSPGASPGTSSTGSPGTPGSGTASSSPGASPGTSSTGSPGASPGTSSTGSPGASPGTSSTGSPGSSPSASTGTGPGTPGSGTASSSPGASPGTSSTGSPGASPGTSSTGSPGASPGTSSTGSPGSSTPSGATGSPGSSTPSGATGSPGASPGTSSTGSPGTPGSGTASSSPGSSTPSGATGSPGSSTPSGATGSPGSSTPSGATGSPGSSPSASTGTGPGASPGTSSTGSPGASPGTSSTGSPGTPGSGTASSSPGASPGTSSTGSPGASPGTSSTGSPGASPGTSSTGSPGASPGTSSTGSPGTPGSGTASSSPGSSTPSGATGSPGTPGSGTASSSPGSSTPSGATGSPGTPGSGTASSSPGSSTPSGATGSPGSSTPSGATGSPGSSPSASTGTGPGSSPSASTGTGPGASPGTSSTGSPGTPGSGTASSSPGSSTPSGATGSPGSSPSASTGTGPGSSPSASTGTGPGASPGTSSTGSPGASPGTSSTGSPGSSTPSGATGSPGSSPSASTGTGPGASPGTSSTGSPGSSPSASTGTGPGTPGSGTASSSPGSSTPSGATGSPGSSTPSGATGSPGASPGTSSTGSP

SEQ ID NO: 54 - protein, 549 aa, Artificial Sequence
  Synthetic FIX-XTEN Fusion Protein pNL118
MQRVNMIMAESPGLITICLLGYLLSAECTVFLDHENANKILNRPKRYNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGAPGSPAGSPTSTEEGTSESATPESGPGSEPATSGSETPASSGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLLSTKFTIYNNMFCAGFHEGGRDSCQGDSGGPHVTEVEGTSFLTGIISWGEECAMKGKYGIYTKVSRYVNWIKEKTKLTGPEGPSKLTRAETGAGSPGAETAEQKLISEEDLSPATGHHHHHHHH

SEQ ID NO: 55 - protein, 549 aa, Artificial Sequence
  Synthetic FIX-XTEN Fusion Protein pNL116
MQRVNMIMAESPGLITICLLGYLLSAECTVFLDHENANKILNRPKRYNSGKLEEFVQGNLERECMEEKCSFEEAREVFENTERTTEFWKQYVDGDQCESNPCLNGGSCKDDINSYECWCPFGFEGKNCELDVTCNGAPGSPAGSPTSTEEGTSESATPESGPGSEPATSGSETPASSIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLLSTKFTIYNNMFCAGFHEGGRDSCQGDSGGPHVTEVEGTSFLTGIISWGEECAMKGKYGIYTKVSRYVNWIKEKTKLTGPEGPSKLTRAETGAGSPGAETAEQKLISEEDLSPATGHHHHHHHH

SEQ ID NO: 56 - protein, 549 aa, Artificial Sequence
  Synthetic FIX-XTEN Fusion Protein pNL117
MQRVNMIMAESPGLITICLLGYLLSAECTVFLDHENANKILNRPKRYNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSAGAPGSPAGSPTSTEEGTSESATPESGPGSEPATSGSETPASSDNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLLSTKFTIYNNMFCAGFHEGGRDSCQGDSGGPHVTEVEGTSFLTGIISWGEECAMKGKYGIYTKVSRYVNWIKEKTKLTGPEGPSKLTRAETGAGSPGAETAEQKLISEEDLSPATGHHHHHHHH

SEQ ID NO: 57 - protein, 549 aa, Artificial Sequence
  Synthetic FIX-XTEN Fusion Protein pNL119
MQRVNMIMAESPGLITICLLGYLLSAECTVFLDHENANKILNRPKRYNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPGAPGSPAGSPTSTEEGTSESATPESGPGSEPATSGSETPASSFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLLSTKFTIYNNMFCAGFHEGGRDSCQGDSGGPHVTEVEGTSFLTGIISWGEECAMKGKYGIYTKVSRYVNWIKEKTKLTGPEGPSKLTRAETGAGSPGAETAEQKLISEEDLSPATGHHHHHHHH

SEQ ID NO: 58 - protein, 549 aa, Artificial Sequence
  Synthetic FIX-XTEN Fusion Protein pNL120
MQRVNMIMAESPGLITICLLGYLLSAECTVFLDHENANKILNRPKRYNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKGAPGSPAGSPTSTEEGTSESATPESGPGSEPATSGSETPASSLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLLSTKFTIYNNMFCAGFHEGGRDSCQGDSGGPHVTEVEGTSFLTGIISWGEECAMKGKYGIYTKVSRYVNWIKEKTKLTGPEGPSKLTRAETGAGSPGAETAEQKLISEEDLSPATGHHHHHHHH

SEQ ID NO: 59 - protein, 549 aa, Artificial Sequence
  Synthetic FIX-XTEN Fusion Protein pNL121
MQRVNMIMAESPGLITICLLGYLLSAECTVFLDHENANKILNRPKRYNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVGAPGSPAGSPTSTEEGTSESATPESGPGSEPATSGSETPASSFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLLSTKFTIYNNMFCAGFHEGGRDSCQGDSGGPHVTEVEGTSFLTGIISWGEECAMKGKYGIYTKVSRYVNWIKEKTKLTGPEGPSKLTRAETGAGSPGAETAEQKLISEEDLSPATGHHHHHHHH

SEQ ID NO: 60 - protein, 549 aa, Artificial Sequence
  Synthetic FIX-XTEN Fusion Protein MOTIF
MQRVNMIMAESPGLITICLLGYLLSAECTVFLDHENANKILNRPKRYNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAEGAPGSPAGSPTSTEEGTSESATPESGPGSEPATSGSETPASSTILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLLSTKFTIYNNMFCAGFHEGGRDSCQGDSGGPHVTEVEGTSFLTGIISWGEECAMKGKYGIYTKVSRYVNWIKEKTKLTGPEGPSKLTRAETGAGSPGAETAEQKLISEEDLSPATGHHHHHHHH

SEQ ID NO: 61 - protein, 549 aa, Artificial Sequence
  Synthetic FIX-XTEN Fusion Protein pNL123
MQRVNMIMAESPGLITICLLGYLLSAECTVFLDHENANKILNRPKRYNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDGAPGSPAGSPTSTEEGTSESATPESGPGSEPATSGSETPASSNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLLSTKFTIYNNMFCAGFHEGGRDSCQGDSGGPHVTEVEGTSFLTGIISWGEECAMKGKYGIYTKVSRYVNWIKEKTKLTGPEGPSKLTRAETGAGSPGAETAEQKLISEEDLSPATGHHHHHHHH

SEQ ID NO: 62 - protein, 549 aa, Artificial Sequence
  Synthetic FIX-XTEN Fusion Protein pNL124
MQRVNMIMAESPGLITICLLGYLLSAECTVFLDHENANKILNRPKRYNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSGAPGSPAGSPTSTEEGTSESATPESGPGSEPATSGSETPASSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLLSTKFTIYNNMFCAGFHEGGRDSCQGDSGGPHVTEVEGTSFLTGIISWGEECAMKGKYGIYTKVSRYVNWIKEKTKLTGPEGPSKLTRAETGAGSPGAETAEQKLISEEDLSPATGHHHHHHHH

SEQ ID NO: 63 - protein, 549 aa, Artificial Sequence
  Synthetic FIX-XTEN Fusion Protein pNL125
MQRVNMIMAESPGLITICLLGYLLSAECTVFLDHENANKILNRPKRYNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKGAPGSPAGSPTSTEEGTSESATPESGPGSEPATSGSETPASSPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLLSTKFTIYNNMFCAGFHEGGRDSCQGDSGGPHVTEVEGTSFLTGIISWGEECAMKGKYGIYTKVSRYVNWIKEKTKLTGPEGPSKLTRAETGAGSPGAETAEQKLISEEDLSPATGHHHHHHHH

SEQ ID NO: 64 - protein, 549 aa, Artificial Sequence
  Synthetic FIX-XTEN Fusion Protein pNL126
MQRVNMIMAESPGLITICLLGYLLSAECTVFLDHENANKILNRPKRYNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVGAPGSPAGSPTSTEEGTSESATPESGPGSEPATSGSETPASSDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLLSTKFTIYNNMFCAGFHEGGRDSCQGDSGGPHVTEVEGTSFLTGIISWGEECAMKGKYGIYTKVSRYVNWIKEKTKLTGPEGPSKLTRAETGAGSPGAETAEQKLISEEDLSPATGHHHHHHHH

SEQ ID NO: 65 - protein, 549 aa, Artificial Sequence
  Synthetic FIX-XTEN Fusion Protein pNL127
MQRVNMIMAESPGLITICLLGYLLSAECTVFLDHENANKILNRPKRYNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVEGAPGSPAGSPTSTEEGTSESATPESGPGSEPATSGSETPASSTGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLLSTKFTIYNNMFCAGFHEGGRDSCQGDSGGPHVTEVEGTSFLTGIISWGEECAMKGKYGIYTKVSRYVNWIKEKTKLTGPEGPSKLTRAETGAGSPGAETAEQKLISEEDLSPATGHHHHHHHH

SEQ ID NO: 66 - protein, 549 aa, Artificial Sequence
  Synthetic FIX-XTEN Fusion Protein  pNL128
MQRVNMIMAESPGLITICLLGYLLSAECTVFLDHENANKILNRPKRYNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEEGAPGSPAGSPTSTEEGTSESATPESGPGSEPATSGSETPASSTEHTEQKRNVIRIIPHHNYNAAINKYNHDIALLELDEPLVLNSYVTPICIADKEYTNIFLKFGSGYVSGWGRVFHKGRSALVLQYLRVPLVDRATCLLSTKFTIYNNMFCAGFHEGGRDSCQGDSGGPHVTEVEGTSFLTGIISWGEECAMKGKYGIYTKVSRYVNWIKEKTKLTGPEGPSKLTRAETGAGSPGAETAEQKLISEEDLSPATGHHHHHHHH

SEQ ID NO: 67 - protein, 549 aa, Artificial Sequence
  Synthetic FIX-XTEN Fusion Protein pNL129
MQRVNMIMAESPGLITICLLGYLLSAECTVFLDHENANKILNRPKRYNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHGAPGSPAGSPTSTEEGTSESATPESGPGSEPATSGSETPASSNYNAAINKYNHDIALLELDEPLVLNSYVTPICIADKEYTNIFLKFGSGYVSGWGRVFHKGRSALVLQYLRVPLVDRATCLLSTKFTIYNNMFCAGFHEGGRDSCQGDSGGPHVTEVEGTSFLTGIISWGEECAMKGKYGIYTKVSRYVNWIKEKTKLTGPEGPSKLTRAETGAGSPGAETAEQKLISEEDLSPATGHHHHHHHH

SEQ ID NO: 68 - protein, 549 aa, Artificial Sequence
  Synthetic FIX-XTEN Fusion Protein pNL130
MQRVNMIMAESPGLITICLLGYLLSAECTVFLDHENANKILNRPKRYNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKGAPGSPAGSPTSTEEGTSESATPESGPGSEPATSGSETPASSYNHDIALLELDEPLVLNSYVTPICIADKEYTNIFLKFGSGYVSGWGRVFHKGRSALVLQYLRVPLVDRATCLLSTKFTIYNNMFCAGFHEGGRDSCQGDSGGPHVTEVEGTSFLTGIISWGEECAMKGKYGIYTKVSRYVNWIKEKTKLTGPEGPSKLTRAETGAGSPGAETAEQKLISEEDLSPATGHHHHHHHH

SEQ ID NO: 69 - protein, 549 aa, Artificial Sequence
  Synthetic FIX-XTEN Fusion Protein pNL131
MQRVNMIMAESPGLITICLLGYLLSAECTVFLDHENANKILNRPKRYNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEGAPGSPAGSPTSTEEGTSESATPESGPGSEPATSGSETPASSPLVLNSYVTPICIADKEYTNIFLKFGSGYVSGWGRVFHKGRSALVLQYLRVPLVDRATCLLSTKFTIYNNMFCAGFHEGGRDSCQGDSGGPHVTEVEGTSFLTGIISWGEECAMKGKYGIYTKVSRYVNWIKEKTKLTGPEGPSKLTRAETGAGSPGAETAEQKLISEEDLSPATGHHHHHHHH

SEQ ID NO: 70 - protein, 549 aa, Artificial Sequence
  Synthetic FIX-XTEN Fusion Protein pNL132
MQRVNMIMAESPGLITICLLGYLLSAECTVFLDHENANKILNRPKRYNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADGAPGSPAGSPTSTEEGTSESATPESGPGSEPATSGSETPASSKEYTNIFLKFGSGYVSGWGRVFHKGRSALVLQYLRVPLVDRATCLLSTKFTIYNNMFCAGFHEGGRDSCQGDSGGPHVTEVEGTSFLTGIISWGEECAMKGKYGIYTKVSRYVNWIKEKTKLTGPEGPSKLTRAETGAGSPGAETAEQKLISEEDLSPATGHHHHHHHH

SEQ ID NO: 71 - protein, 549 aa, Artificial Sequence
  Synthetic FIX-XTEN Fusion Protein pNL133
MQRVNMIMAESPGLITICLLGYLLSAECTVFLDHENANKILNRPKRYNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGAPGSPAGSPTSTEEGTSESATPESGPGSEPATSGSETPASSGRSALVLQYLRVPLVDRATCLLSTKFTIYNNMFCAGFHEGGRDSCQGDSGGPHVTEVEGTSFLTGIISWGEECAMKGKYGIYTKVSRYVNWIKEKTKLTGPEGPSKLTRAETGAGSPGAETAEQKLISEEDLSPATGHHHHHHHH

SEQ ID NO: 72 - protein, 549 aa, Artificial Sequence
  Synthetic FIX-XTEN Fusion Protein pNL134
MQRVNMIMAESPGLITICLLGYLLSAECTVFLDHENANKILNRPKRYNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLLSTKGAPGSPAGSPTSTEEGTSESATPESGPGSEPATSGSETPASSFTIYNNMFCAGFHEGGRDSCQGDSGGPHVTEVEGTSFLTGIISWGEECAMKGKYGIYTKVSRYVNWIKEKTKLTGPEGPSKLTRAETGAGSPGAETAEQKLISEEDLSPATGHHHHHHHH

SEQ ID NO: 73 - protein, 549 aa, Artificial Sequence
  Synthetic FIX-XTEN Fusion Protein pNL135
MQRVNMIMAESPGLITICLLGYLLSAECTVFLDHENANKILNRPKRYNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLLSTKFTIYNNMFCAGFHGAPGSPAGSPTSTEEGTSESATPESGPGSEPATSGSETPASSEGGRDSCQGDSGGPHVTEVEGTSFLTGIISWGEECAMKGKYGIYTKVSRYVNWIKEKTKLTGPEGPSKLTRAETGAGSPGAETAEQKLISEEDLSPATGHHHHHHHH

SEQ ID NO: 74 - protein, 549 aa, Artificial Sequence
  Synthetic FIX-XTEN Fusion Protein pNL136
MQRVNMIMAESPGLITICLLGYLLSAECTVFLDHENANKILNRPKRYNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLLSTKFTIYNNMFCAGFHEGGRDSCQGDSGGPHVTEVEGTSFLTGIISWGEECAMKGAPGSPAGSPTSTEEGTSESATPESGPGSEPATSGSETPASSGKYGIYTKVSRYVNWIKEKTKLTGPEGPSKLTRAETGAGSPGAETAEQKLISEEDLSPATGHHHHHHHH

SEQ ID NO: 75 - protein, 549 aa, Artificial Sequence
  Synthetic FIX-XTEN Fusion Protein pNL137
MQRVNMIMAESPGLITICLLGYLLSAECTVFLDHENANKILNRPKRYNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLLSTKFTIYNNMFCAGFHEGGRDSCQGDSGGPHVTEVEGTSFLTGIISWGEECAMKGKYGIYTKVSRGAPGSPAGSPTSTEEGTSESATPESGPGSEPATSGSETPASSYVNWIKEKTKLTGPEGPSKLTRAETGAGSPGAETAEQKLISEEDLSPATGHHHHHHHH

SEQ ID NO: 76 - protein, 549 aa, Artificial Sequence
  Synthetic FIX-XTEN Fusion Protein pNL138
MQRVNMIMAESPGLITICLLGYLLSAECTVFLDHENANKILNRPKRYNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLLSTKFTIYNNMFCAGFHEGGRDSCQGDSGGPHVTEVEGTSFLTGIISWGEECAMKGKYGIYTKVSRYVNWIKEKTKGAPGSPAGSPTSTEEGTSESATPESGPGSEPATSGSETPASSLTGPEGPSKLTRAETGAGSPGAETAEQKLISEEDLSPATGHHHHHHHH

SEQ ID NO: 77 - protein, 575 aa, Artificial Sequence
  Synthetic FIX-XTEN Fusion Protein pNL140
MQRVNMIMAESPGLITICLLGYLLSAECTVFLDHENANKILNRPKRYNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLLSTKFTIYNNMFCAGFHEGGRDSCQGDSGGPHVTEVEGTSFLTGIISWGEECAMKGKYGIYTKVSRYVNWIKEKTKLTGAGSPGAETALVPRSFLLRNPNDKYEPFWEDEESGAGSPGAETAGAPGSPAGSPTSTEEGTSESATPESGPGSEPATSGSETPASSGAETAEQKLISEEDLSPATGHHHHHHHH

SEQ ID NO: 78 - protein, 549 aa, Artificial Sequence
  Synthetic FIX-XTEN Fusion Protein pNL141 MOTIF
MQRVNMIMAESPGLITICLLGYLLSAECTVFLDHENANKILNRPKRYNSGKLEEFVQGNLERECMEEKCSFEEAREVFENTERTTEFWKQYVDGDQCEGAPGSPAGSPTSTEEGTSESATPESGPGSEPATSGSETPASSSNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLLSTKFTIYNNMFCAGFHEGGRDSCQGDSGGPHVTEVEGTSFLTGIISWGEECAMKGKYGIYTKVSRYVNWIKEKTKLTGPEGPSKLTRAETGAGSPGAETAEQKLISEEDLSPATGHHHHHHHH

SEQ ID NO: 79 - protein, 549 aa, Artificial Sequence
  Synthetic FIX-XTEN Fusion Protein pNL142
MQRVNMIMAESPGLITICLLGYLLSAECTVFLDHENANKILNRPKRYNSGKLEEFVQGNLERECMEEKCSFEEAREVFENTERTTEFWKQYVDGDQCESNPCLNGGAPGSPAGSPTSTEEGTSESATPESGPGSEPATSGSETPASSGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLLSTKFTIYNNMFCAGFHEGGRDSCQGDSGGPHVTEVEGTSFLTGIISWGEECAMKGKYGIYTKVSRYVNWIKEKTKLTGPEGPSKLTRAETGAGSPGAETAEQKLISEEDLSPATGHHHHHHHH

SEQ ID NO: 80 - protein, 549 aa, Artificial Sequence
  Synthetic FIX-XTEN Fusion Protein pNL143
MQRVNMIMAESPGLITICLLGYLLSAECTVFLDHENANKILNRPKRYNSGKLEEFVQGNLERECMEEKCSFEEAREVFENTERTTEFWKQYVDGDQCESNPCLNGGSCKDDIGAPGSPAGSPTSTEEGTSESATPESGPGSEPATSGSETPASSNSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLLSTKFTIYNNMFCAGFHEGGRDSCQGDSGGPHVTEVEGTSFLTGIISWGEECAMKGKYGIYTKVSRYVNWIKEKTKLTGPEGPSKLTRAETGAGSPGAETAEQKLISEEDLSPATGHHHHHHHH

SEQ ID NO: 81 - protein, 549 aa, Artificial Sequence
  Synthetic FIX-XTEN Fusion Protein  pNL144
MQRVNMIMAESPGLITICLLGYLLSAECTVFLDHENANKILNRPKRYNSGKLEEFVQGNLERECMEEKCSFEEAREVFENTERTTEFWKQYVDGDQCESNPCLNGGSCKDDINSYECWCPFGFEGKGAPGSPAGSPTSTEEGTSESATPESGPGSEPATSGSETPASSNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLLSTKFTIYNNMFCAGFHEGGRDSCQGDSGGPHVTEVEGTSFLTGIISWGEECAMKGKYGIYTKVSRYVNWIKEKTKLTGPEGPSKLTRAETGAGSPGAETAEQKLISEEDLSPATGHHHHHHHH

SEQ ID NO: 82 - protein, 549 aa, Artificial Sequence
  Synthetic FIX-XTEN Fusion Protein pNL145
MQRVNMIMAESPGLITICLLGYLLSAECTVFLDHENANKILNRPKRYNSGKLEEFVQGNLERECMEEKCSFEEAREVFENTERTTEFWKQYVDGDQCESNPCLNGGSCKDDINSYECWCPFGFEGKNCELDGAPGSPAGSPTSTEEGTSESATPESGPGSEPATSGSETPASSVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLLSTKFTIYNNMFCAGFHEGGRDSCQGDSGGPHVTEVEGTSFLTGIISWGEECAMKGKYGIYTKVSRYVNWIKEKTKLTGPEGPSKLTRAETGAGSPGAETAEQKLISEEDLSPATGHHHHHHHH

SEQ ID NO: 83 - protein, 683 aa, Artificial Sequence
  Synthetic FIX-XTEN Fusion Protein  pNL164
MQRVNMIMAESPGLITICLLGYLLSAECTVFLDHENANKILNRPKRYNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLLSTKFTIYNNMFCAGFHEGGRDSCQGDSGGPHVTEVEGTSFLTGIISWGEECAMKGKYGIYTKVSRYVNWIKEKTKLTGAGSPGAETALVPRSFLLRNPNDKYEPFWEDEESGAGSPGAETAGAPTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAPGASSGAETAEQKLISEEDLSPATGHHHHHHHH

SEQ ID NO: 84 - protein, 827 aa, Artificial Sequence
  Synthetic FIX-XTEN Fusion Protein pNL165
MQRVNMIMAESPGLITICLLGYLLSAECTVFLDHENANKILNRPKRYNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLLSTKFTIYNNMFCAGFHEGGRDSCQGDSGGPHVTEVEGTSFLTGIISWGEECAMKGKYGIYTKVSRYVNWIKEKTKLTGAGSPGAETALVPRSFLLRNPNDKYEPFWEDEESGAGSPGAETAGAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAPASSGAETAEQKLISEEDLSPATGHHHHHHHH

SEQ ID NO: 85 - protein, 1403 aa, Artificial Sequence
  Synthetic FIX-XTEN Fusion Protein  pNL166
MQRVNMIMAESPGLITICLLGYLLSAECTVFLDHENANKILNRPKRYNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLLSTKFTIYNNMFCAGFHEGGRDSCQGDSGGPHVTEVEGTSFLTGIISWGEECAMKGKYGIYTKVSRYVNWIKEKTKLTGAGSPGAETALVPRSFLLRNPNDKYEPFWEDEESGAGSPGAETAGAPGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAPASSGAETAEQKLISEEDLSPATGHHHHHHHH

SEQ ID NO: 86 - protein, 585 aa, Artificial Sequence
  Synthetic FIX-XTEN Fusion Protein pNL167
MQRVNMIMAESPGLITICLLGYLLSAECTVFLDHENANKILNRPKRYNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKGAPSPAGSPTSTEEGTSESATPESGPGSEPATSGSETPGTSESATPESGPGTSTEPSEGSAPGTSTEPSEGSAPGASSLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLLSTKFTIYNNMFCAGFHEGGRDSCQGDSGGPHVTEVEGTSFLTGIISWGEECAMKGKYGIYTKVSRYVNWIKEKTKLTGPEGPSKLTRAETGAGSPGAETAEQKLISEEDLSPATGHHHHHHHH

SEQ ID NO: 87 - protein, 657 aa, Artificial Sequence
  Synthetic FIX-XTEN Fusion Protein pNL168
MQRVNMIMAESPGLITICLLGYLLSAECTVFLDHENANKILNRPKRYNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKGAPSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGASSLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLLSTKFTIYNNMFCAGFHEGGRDSCQGDSGGPHVTEVEGTSFLTGIISWGEECAMKGKYGIYTKVSRYVNWIKEKTKLTGPEGPSKLTRAETGAGSPGAETAEQKLISEEDLSPATGHHHHHHHH

SEQ ID NO: 88 - protein, 801 aa, Artificial Sequence
  Synthetic FIX-XTEN Fusion Protein pNL169
MQRVNMIMAESPGLITICLLGYLLSAECTVFLDHENANKILNRPKRYNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKGAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAPASSLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLLSTKFTIYNNMFCAGFHEGGRDSCQGDSGGPHVTEVEGTSFLTGIISWGEECAMKGKYGIYTKVSRYVNWIKEKTKLTGPEGPSKLTRAETGAGSPGAETAEQKLISEEDLSPATGHHHHHHHH

SEQ ID NO: 89 - protein, 585 aa, Artificial Sequence
  Synthetic FIX-XTEN Fusion Protein pNL170
MQRVNMIMAESPGLITICLLGYLLSAECTVFLDHENANKILNRPKRYNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVGAPSPAGSPTSTEEGTSESATPESGPGSEPATSGSETPGTSESATPESGPGTSTEPSEGSAPGTSTEPSEGSAPGASSFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLLSTKFTIYNNMFCAGFHEGGRDSCQGDSGGPHVTEVEGTSFLTGIISWGEECAMKGKYGIYTKVSRYVNWIKEKTKLTGPEGPSKLTRAETGAGSPGAETAEQKLISEEDLSPATGHHHHHHHH

SEQ ID NO: 90 - protein, 657 aa, Artificial Sequence
  Synthetic FIX-XTEN Fusion Protein pNL171
MQRVNMIMAESPGLITICLLGYLLSAECTVFLDHENANKILNRPKRYNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVGAPSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGASSFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLLSTKFTIYNNMFCAGFHEGGRDSCQGDSGGPHVTEVEGTSFLTGIISWGEECAMKGKYGIYTKVSRYVNWIKEKTKLTGPEGPSKLTRAETGAGSPGAETAEQKLISEEDLSPATGHHHHHHHH

SEQ ID NO: 91 - protein, 801 aa, Artificial Sequence
  Synthetic FIX-XTEN Fusion Protein pNL172
MQRVNMIMAESPGLITICLLGYLLSAECTVFLDHENANKILNRPKRYNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVGAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAPASSFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLLSTKFTIYNNMFCAGFHEGGRDSCQGDSGGPHVTEVEGTSFLTGIISWGEECAMKGKYGIYTKVSRYVNWIKEKTKLTGPEGPSKLTRAETGAGSPGAETAEQKLISEEDLSPATGHHHHHHHH

SEQ ID NO: 92 - protein, 585 aa, Artificial Sequence
  Synthetic FIX-XTEN Fusion Protein pNL173
MQRVNMIMAESPGLITICLLGYLLSAECTVFLDHENANKILNRPKRYNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAEGAPSPAGSPTSTEEGTSESATPESGPGSEPATSGSETPGTSESATPESGPGTSTEPSEGSAPGTSTEPSEGSAPGASSTILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLLSTKFTIYNNMFCAGFHEGGRDSCQGDSGGPHVTEVEGTSFLTGIISWGEECAMKGKYGIYTKVSRYVNWIKEKTKLTGPEGPSKLTRAETGAGSPGAETAEQKLISEEDLSPATGHHHHHHHH

SEQ ID NO: 93 - protein, 657 aa, Artificial Sequence
  Synthetic FIX-XTEN Fusion Protein pNL174
MQRVNMIMAESPGLITICLLGYLLSAECTVFLDHENANKILNRPKRYNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAEGAPSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGASSTILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLLSTKFTIYNNMFCAGFHEGGRDSCQGDSGGPHVTEVEGTSFLTGIISWGEECAMKGKYGIYTKVSRYVNWIKEKTKLTGPEGPSKLTRAETGAGSPGAETAEQKLISEEDLSPATGHHHHHHHH

SEQ ID NO: 94 - protein, 801 aa, Artificial Sequence
  Synthetic FIX-XTEN Fusion Protein pNL175
MQRVNMIMAESPGLITICLLGYLLSAECTVFLDHENANKILNRPKRYNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAEGAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAPASSTILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLLSTKFTIYNNMFCAGFHEGGRDSCQGDSGGPHVTEVEGTSFLTGIISWGEECAMKGKYGIYTKVSRYVNWIKEKTKLTGPEGPSKLTRAETGAGSPGAETAEQKLISEEDLSPATGHHHHHHHH

SEQ ID NO: 95 - protein, 585 aa, Artificial Sequence
  Synthetic FIX-XTEN Fusion Protein pNL176
MQRVNMIMAESPGLITICLLGYLLSAECTVFLDHENANKILNRPKRYNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDGAPSPAGSPTSTEEGTSESATPESGPGSEPATSGSETPGTSESATPESGPGTSTEPSEGSAPGTSTEPSEGSAPGASSNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLLSTKFTIYNNMFCAGFHEGGRDSCQGDSGGPHVTEVEGTSFLTGIISWGEECAMKGKYGIYTKVSRYVNWIKEKTKLTGPEGPSKLTRAETGAGSPGAETAEQKLISEEDLSPATGHHHHHHHH

SEQ ID NO: 96 - protein, 657 aa, Artificial Sequence
  Synthetic FIX-XTEN Fusion Protein pNL177
MQRVNMIMAESPGLITICLLGYLLSAECTVFLDHENANKILNRPKRYNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDGAPSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGASSNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLLSTKFTIYNNMFCAGFHEGGRDSCQGDSGGPHVTEVEGTSFLTGIISWGEECAMKGKYGIYTKVSRYVNWIKEKTKLTGPEGPSKLTRAETGAGSPGAETAEQKLISEEDLSPATGHHHHHHHH

SEQ ID NO: 97 - protein, 801 aa, Artificial Sequence
  Synthetic FIX-XTEN Fusion Protein pNL178
MQRVNMIMAESPGLITICLLGYLLSAECTVFLDHENANKILNRPKRYNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDGAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAPASSNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLLSTKFTIYNNMFCAGFHEGGRDSCQGDSGGPHVTEVEGTSFLTGIISWGEECAMKGKYGIYTKVSRYVNWIKEKTKLTGPEGPSKLTRAETGAGSPGAETAEQKLISEEDLSPATGHHHHHHHH

SEQ ID NO: 98 - protein, 585 aa, Artificial Sequence
  Synthetic FIX-XTEN Fusion Protein pNL179
MQRVNMIMAESPGLITICLLGYLLSAECTVFLDHENANKILNRPKRYNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSGAPSPAGSPTSTEEGTSESATPESGPGSEPATSGSETPGTSESATPESGPGTSTEPSEGSAPGTSTEPSEGSAPGASSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLLSTKFTIYNNMFCAGFHEGGRDSCQGDSGGPHVTEVEGTSFLTGIISWGEECAMKGKYGIYTKVSRYVNWIKEKTKLTGPEGPSKLTRAETGAGSPGAETAEQKLISEEDLSPATGHHHHHHHH

SEQ ID NO: 99 - protein, 657 aa, Artificial Sequence
  Synthetic FIX-XTEN Fusion Protein pNL180
MQRVNMIMAESPGLITICLLGYLLSAECTVFLDHENANKILNRPKRYNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSGAPSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGASSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLLSTKFTIYNNMFCAGFHEGGRDSCQGDSGGPHVTEVEGTSFLTGIISWGEECAMKGKYGIYTKVSRYVNWIKEKTKLTGPEGPSKLTRAETGAGSPGAETAEQKLISEEDLSPATGHHHHHHHH

SEQ ID NO: 100 - protein, 801 aa, Artificial Sequence
  Synthetic FIX-XTEN Fusion Protein pNL181
MQRVNMIMAESPGLITICLLGYLLSAECTVFLDHENANKILNRPKRYNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSGAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAPASSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLLSTKFTIYNNMFCAGFHEGGRDSCQGDSGGPHVTEVEGTSFLTGIISWGEECAMKGKYGIYTKVSRYVNWIKEKTKLTGPEGPSKLTRAETGAGSPGAETAEQKLISEEDLSPATGHHHHHHHH

SEQ ID NO: 101 - protein, 585 aa, Artificial Sequence
  Synthetic FIX-XTEN Fusion Protein pNL182
MQRVNMIMAESPGLITICLLGYLLSAECTVFLDHENANKILNRPKRYNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVEGAPSPAGSPTSTEEGTSESATPESGPGSEPATSGSETPGTSESATPESGPGTSTEPSEGSAPGTSTEPSEGSAPGASSTGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLLSTKFTIYNNMFCAGFHEGGRDSCQGDSGGPHVTEVEGTSFLTGIISWGEECAMKGKYGIYTKVSRYVNWIKEKTKLTGPEGPSKLTRAETGAGSPGAETAEQKLISEEDLSPATGHHHHHHHH

SEQ ID NO: 102 - protein, 657 aa, Artificial Sequence
  Synthetic FIX-XTEN Fusion Protein pNL183
MQRVNMIMAESPGLITICLLGYLLSAECTVFLDHENANKILNRPKRYNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVEGAPSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGASSTGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLLSTKFTIYNNMFCAGFHEGGRDSCQGDSGGPHVTEVEGTSFLTGIISWGEECAMKGKYGIYTKVSRYVNWIKEKTKLTGPEGPSKLTRAETGAGSPGAETAEQKLISEEDLSPATGHHHHHHHH

SEQ ID NO: 103 - protein, 801 aa, Artificial Sequence
  Synthetic FIX-XTEN Fusion Protein pNL184
MQRVNMIMAESPGLITICLLGYLLSAECTVFLDHENANKILNRPKRYNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVEGAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAPASSTGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLLSTKFTIYNNMFCAGFHEGGRDSCQGDSGGPHVTEVEGTSFLTGIISWGEECAMKGKYGIYTKVSRYVNWIKEKTKLTGPEGPSKLTRAETGAGSPGAETAEQKLISEEDLSPATGHHHHHHHH

SEQ ID NO: 104 - protein, 585 aa, Artificial Sequence
  Synthetic FIX-XTEN Fusion Protein pNL185
MQRVNMIMAESPGLITICLLGYLLSAECTVFLDHENANKILNRPKRYNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLLSTKFTIYNNMFCAGFHEGGRDSCQGDSGGPHVTEVEGTSFLTGIISWGEECAMKGKYGIYTKVSRYVNWIKEKTKGAPSPAGSPTSTEEGTSESATPESGPGSEPATSGSETPGTSESATPESGPGTSTEPSEGSAPGTSTEPSEGSAPGASSLTGPEGPSKLTRAETGAGSPGAETAEQKLISEEDLSPATGHHHHHHHH

SEQ ID NO: 105 - protein, 657 aa, Artificial Sequence
  Synthetic FIX-XTEN Fusion Protein pNL186
MQRVNMIMAESPGLITICLLGYLLSAECTVFLDHENANKILNRPKRYNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLLSTKFTIYNNMFCAGFHEGGRDSCQGDSGGPHVTEVEGTSFLTGIISWGEECAMKGKYGIYTKVSRYVNWIKEKTKGAPSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGASSLTGPEGPSKLTRAETGAGSPGAETAEQKLISEEDLSPATGHHHHHHHH

SEQ ID NO: 106 - protein, 801 aa, Artificial Sequence
  Synthetic FIX-XTEN Fusion Protein pNL187
MQRVNMIMAESPGLITICLLGYLLSAECTVFLDHENANKILNRPKRYNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLLSTKFTIYNNMFCAGFHEGGRDSCQGDSGGPHVTEVEGTSFLTGIISWGEECAMKGKYGIYTKVSRYVNWIKEKTKGAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAPASSLTGPEGPSKLTRAETGAGSPGAETAEQKLISEEDLSPATGHHHHHHHH

SEQ ID NO: 107 - protein, 585 aa, Artificial Sequence
  Synthetic FIX-XTEN Fusion Protein pNL188
MQRVNMIMAESPGLITICLLGYLLSAECTVFLDHENANKILNRPKRYNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSAGAPSPAGSPTSTEEGTSESATPESGPGSEPATSGSETPGTSESATPESGPGTSTEPSEGSAPGTSTEPSEGSAPGASSDNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLLSTKFTIYNNMFCAGFHEGGRDSCQGDSGGPHVTEVEGTSFLTGIISWGEECAMKGKYGIYTKVSRYVNWIKEKTKLTGPEGPSKLTRAETGAGSPGAETAEQKLISEEDLSPATGHHHHHHHH

SEQ ID NO: 108 - protein, 657 aa, Artificial Sequence
  Synthetic FIX-XTEN Fusion Protein pNL189
MQRVNMIMAESPGLITICLLGYLLSAECTVFLDHENANKILNRPKRYNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSAGAPSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGASSDNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLLSTKFTIYNNMFCAGFHEGGRDSCQGDSGGPHVTEVEGTSFLTGIISWGEECAMKGKYGIYTKVSRYVNWIKEKTKLTGPEGPSKLTRAETGAGSPGAETAEQKLISEEDLSPATGHHHHHHHH

SEQ ID NO: 109 - protein, 801 aa, Artificial Sequence
  Synthetic FIX-XTEN Fusion Protein pNL190
MQRVNMIMAESPGLITICLLGYLLSAECTVFLDHENANKILNRPKRYNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSAGAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAPASSDNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLLSTKFTIYNNMFCAGFHEGGRDSCQGDSGGPHVTEVEGTSFLTGIISWGEECAMKGKYGIYTKVSRYVNWIKEKTKLTGPEGPSKLTRAETGAGSPGAETAEQKLISEEDLSPATGHHHHHHHH

SEQ ID NO: 110 - protein, 549 aa, Artificial Sequence
  Synthetic FIX-XTEN Fusion Protein pNL195
MQRVNMIMAESPGLITICLLGYLLSAECTVFLDHENANKILNRPKRYNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGGAPGSPAGSPTSTEEGTSESATPESGPGSEPATSGSETPASSVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLLSTKFTIYNNMFCAGFHEGGRDSCQGDSGGPHVTEVEGTSFLTGIISWGEECAMKGKYGIYTKVSRYVNWIKEKTKLTGPEGPSKLTRAETGAGSPGAETAEQKLISEEDLSPATGHHHHHHHH

SEQ ID NO: 111 - protein, 549 aa, Artificial Sequence
  Synthetic FIX-XTEN Fusion Protein pNL196
MQRVNMIMAESPGLITICLLGYLLSAECTVFLDHENANKILNRPKRYNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKGAPGSPAGSPTSTEEGTSESATPESGPGSEPATSGSETPASSITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLLSTKFTIYNNMFCAGFHEGGRDSCQGDSGGPHVTEVEGTSFLTGIISWGEECAMKGKYGIYTKVSRYVNWIKEKTKLTGPEGPSKLTRAETGAGSPGAETAEQKLISEEDLSPATGHHHHHHHH

SEQ ID NO: 112 - protein, 549 aa, Artificial Sequence
  Synthetic FIX-XTEN Fusion Protein pNL197
MQRVNMIMAESPGLITICLLGYLLSAECTVFLDHENANKILNRPKRYNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITGAPGSPAGSPTSTEEGTSESATPESGPGSEPATSGSETPASSVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLLSTKFTIYNNMFCAGFHEGGRDSCQGDSGGPHVTEVEGTSFLTGIISWGEECAMKGKYGIYTKVSRYVNWIKEKTKLTGPEGPSKLTRAETGAGSPGAETAEQKLISEEDLSPATGHHHHHHHH

SEQ ID NO: 113 - protein, 549 aa, Artificial Sequence
  Synthetic FIX-XTEN Fusion Protein pNL198
MQRVNMIMAESPGLITICLLGYLLSAECTVFLDHENANKILNRPKRYNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNGAPGSPAGSPTSTEEGTSESATPESGPGSEPATSGSETPASSKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLLSTKFTIYNNMFCAGFHEGGRDSCQGDSGGPHVTEVEGTSFLTGIISWGEECAMKGKYGIYTKVSRYVNWIKEKTKLTGPEGPSKLTRAETGAGSPGAETAEQKLISEEDLSPATGHHHHHHHH

SEQ ID NO: 114 - protein, 549 aa, Artificial Sequence
  Synthetic FIX-XTEN Fusion Protein pNL199
MQRVNMIMAESPGLITICLLGYLLSAECTVFLDHENANKILNRPKRYNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSGAPGSPAGSPTSTEEGTSESATPESGPGSEPATSGSETPASSYVTPICIADKEYTNIFLKFGSGYVSGWGRVFHKGRSALVLQYLRVPLVDRATCLLSTKFTIYNNMFCAGFHEGGRDSCQGDSGGPHVTEVEGTSFLTGIISWGEECAMKGKYGIYTKVSRYVNWIKEKTKLTGPEGPSKLTRAETGAGSPGAETAEQKLISEEDLSPATGHHHHHHHH

SEQ ID NO: 115 - protein, 611 aa, Artificial Sequence
  Synthetic FIX-XTEN Fusion Protein pNL202
MQRVNMIMAESPGLITICLLGYLLSAECTVFLDHENANKILNRPKRYNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLLSTKFTIYNNMFCAGFHEGGRDSCQGDSGGPHVTEVEGTSFLTGIISWGEECAMKGKYGIYTKVSRYVNWIKEKTKLTGAGSPGAETALVPRSFLLRNPNDKYEPFWEDEESGAGSPGAETAGAPSPAGSPTSTEEGTSESATPESGPGSEPATSGSETPGTSESATPESGPGTSTEPSEGSAPGTSTEPSEGSAPGASSGAETAEQKLISEEDLSPATGHHHHHHHH

SEQ ID NO: 116 - protein, 1345 aa, Artificial Sequence
  Synthetic FIX-XTEN Fusion Protein FIX-092
MQRVNMIMAESPGLITICLLGYLLSAECTVFLDHENANKILNRPKRYNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLTGPEGPSKLTRAETGSPGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAPGSSS

SEQ ID NO: 117 - protein, 655 aa, Artificial Sequence
  Synthetic FIX-XTEN Fusion Protein pJH0131
MQRVNMIMAESPGLITICLLGYLLSAECTVFLDHENANKILNRPKRYNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLLSTKFTIYNNMFCAGFHEGGRDSCQGDSGGPHVTEVEGTSFLTGIISWGEECAMKGKYGIYTKVSRYVNWIKEKTKLTGAGSPGAETALVPRSFLLRNPNDKYEPFWEDEESGAGSPGAETAGAPSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGASS

SEQ ID NO: 118 - protein, 503 aa, Artificial Sequence
  Synthetic FIX-XTEN Fusion Protein pJH44
MQRVNMIMAESPGLITICLLGYLLSAECTVFLDHENANKILNRPKRYNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNGAPGSPAGSPTSTEEGTSESATPESGPGSEPATSGSETPASSKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLLSTKFTIYNNMFCAGFHEGGRDSCQGDSGGPHVTEVEGTSFLTGIISWGEECAMKGKYGIYTKVSRYVNWIKEKTKLT

SEQ ID NO: 119 - protein, 539 aa, Artificial Sequence
  Synthetic FIX-XTEN Fusion Protein pJH46
MQRVNMIMAESPGLITICLLGYLLSAECTVFLDHENANKILNRPKRYNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDGAPSPAGSPTSTEEGTSESATPESGPGSEPATSGSETPGTSESATPESGPGTSTEPSEGSAPGTSTEPSEGSAPGASSNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLLSTKFTIYNNMFCAGFHEGGRDSCQGDSGGPHVTEVEGTSFLTGIISWGEECAMKGKYGIYTKVSRYVNWIKEKTKLT

SEQ ID NO: 120 - protein, 611 aa, Artificial Sequence
  Synthetic FIX-XTEN Fusion Protein pJH47
MQRVNMIMAESPGLITICLLGYLLSAECTVFLDHENANKILNRPKRYNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDGAPSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGASSNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLLSTKFTIYNNMFCAGFHEGGRDSCQGDSGGPHVTEVEGTSFLTGIISWGEECAMKGKYGIYTKVSRYVNWIKEKTKLT

SEQ ID NO: 121 - protein, 655 aa, Artificial Sequence
  Synthetic FIX-XTEN Fusion Protein pJH50
MQRVNMIMAESPGLITICLLGYLLSAECTVFLDHENANKILNRPKRYNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLLSTKFTIYNNMFCAGFHEGGRDSCQGDSGGPHVTEVEGTSFLTGIISWGEECAMKGKYGIYTKVSRYVNWIKEKTKLTGAGSPGAETALVPRSFLLRNPNDKYEPFWEDEESGAGSPGAETAGAPTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAPGASS

SEQ ID NO: 122 - protein, 799 aa, Artificial Sequence
  Synthetic FIX-XTEN Fusion Protein pJH51
MQRVNMIMAESPGLITICLLGYLLSAECTVFLDHENANKILNRPKRYNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLLSTKFTIYNNMFCAGFHEGGRDSCQGDSGGPHVTEVEGTSFLTGIISWGEECAMKGKYGIYTKVSRYVNWIKEKTKLTGAGSPGAETALVPRSFLLRNPNDKYEPFWEDEESGAGSPGAETAGAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAPASS

SEQ ID NO: 123 - protein, 583 aa, Artificial Sequence
  Synthetic FIX-XTEN Fusion Protein pJH52
MQRVNMIMAESPGLITICLLGYLLSAECTVFLDHENANKILNRPKRYNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLLSTKFTIYNNMFCAGFHEGGRDSCQGDSGGPHVTEVEGTSFLTGIISWGEECAMKGKYGIYTKVSRYVNWIKEKTKLTGAGSPGAETALVPRSFLLRNPNDKYEPFWEDEESGAGSPGAETAGAPTSESATPESGPGSEPATSGSETPGTSESATPESGPGSEPATSGSETPGTSESATPESGPGTSTEPSEGSAPGASS

SEQ ID NO: 124 - protein, 503 aa, Artificial Sequence
  Synthetic FIX-XTEN Fusion Protein pJH54
MQRVNMIMAESPGLITICLLGYLLSAECTVFLDHENANKILNRPKRYNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVEGAPGSPAGSPTSTEEGTSESATPESGPGSEPATSGSETPASSTGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLLSTKFTIYNNMFCAGFHEGGRDSCQGDSGGPHVTEVEGTSFLTGIISWGEECAMKGKYGIYTKVSRYVNWIKEKTKLT

SEQ ID NO: 125 - protein, 503 aa, Artificial Sequence
  Synthetic FIX-XTEN Fusion Protein pJH55
MQRVNMIMAESPGLITICLLGYLLSAECTVFLDHENANKILNRPKRYNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDGAPGSPAGSPTSTEEGTSESATPESGPGSEPATSGSETPASSNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLLSTKFTIYNNMFCAGFHEGGRDSCQGDSGGPHVTEVEGTSFLTGIISWGEECAMKGKYGIYTKVSRYVNWIKEKTKLT

SEQ ID NO: 126 - protein, 625 aa, Artificial Sequence
  Synthetic FIX-XTEN Fusion Protein pJH59
MQRVNMIMAESPGLITICLLGYLLSAECTVFLDHENANKILNRPKRYNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDGAPGSPAGSPTSTEEGTSESATPESGPGSEPATSGSETPASSNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLLSTKFTIYNNMFCAGFHEGGRDSCQGDSGGPHVTEVEGTSFLTGIISWGEECAMKGKYGIYTKVSRYVNWIKEKTKLTGAGSPGAETALVPRSFLLRNPNDKYEPFWEDEESGAGSPGAETAGAPTSESATPESGPGSEPATSGSETPGTSESATPESGPGSEPATSGSETPGTSESATPESGPGTSTEPSEGSAPGASS

SEQ ID NO: 127 - protein, 697 aa, Artificial Sequence
  Synthetic FIX-XTEN Fusion Protein pJH60
MQRVNMIMAESPGLITICLLGYLLSAECTVFLDHENANKILNRPKRYNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDGAPGSPAGSPTSTEEGTSESATPESGPGSEPATSGSETPASSNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLLSTKFTIYNNMFCAGFHEGGRDSCQGDSGGPHVTEVEGTSFLTGIISWGEECAMKGKYGIYTKVSRYVNWIKEKTKLTGAGSPGAETALVPRSFLLRNPNDKYEPFWEDEESGAGSPGAETAGAPTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAPGASS

SEQ ID NO: 128 - protein, 841 aa, Artificial Sequence
  Synthetic FIX-XTEN Fusion Protein pJH61
MQRVNMIMAESPGLITICLLGYLLSAECTVFLDHENANKILNRPKRYNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDGAPGSPAGSPTSTEEGTSESATPESGPGSEPATSGSETPASSNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLLSTKFTIYNNMFCAGFHEGGRDSCQGDSGGPHVTEVEGTSFLTGIISWGEECAMKGKYGIYTKVSRYVNWIKEKTKLTGAGSPGAETALVPRSFLLRNPNDKYEPFWEDEESGAGSPGAETAGAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAPASS

SEQ ID NO: 129 - protein, 661 aa, Artificial Sequence
  Synthetic FIX-XTEN Fusion Protein pJH62
MQRVNMIMAESPGLITICLLGYLLSAECTVFLDHENANKILNRPKRYNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDGAPSPAGSPTSTEEGTSESATPESGPGSEPATSGSETPGTSESATPESGPGTSTEPSEGSAPGTSTEPSEGSAPGASSNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLLSTKFTIYNNMFCAGFHEGGRDSCQGDSGGPHVTEVEGTSFLTGIISWGEECAMKGKYGIYTKVSRYVNWIKEKTKLTGAGSPGAETALVPRSFLLRNPNDKYEPFWEDEESGAGSPGAETAGAPTSESATPESGPGSEPATSGSETPGTSESATPESGPGSEPATSGSETPGTSESATPESGPGTSTEPSEGSAPGASS

SEQ ID NO: 130 - protein, 733 aa, Artificial Sequence
  Synthetic FIX-XTEN Fusion Protein pJH63
MQRVNMIMAESPGLITICLLGYLLSAECTVFLDHENANKILNRPKRYNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDGAPSPAGSPTSTEEGTSESATPESGPGSEPATSGSETPGTSESATPESGPGTSTEPSEGSAPGTSTEPSEGSAPGASSNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLLSTKFTIYNNMFCAGFHEGGRDSCQGDSGGPHVTEVEGTSFLTGIISWGEECAMKGKYGIYTKVSRYVNWIKEKTKLTGAGSPGAETALVPRSFLLRNPNDKYEPFWEDEESGAGSPGAETAGAPTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAPGASS

SEQ ID NO: 131 - protein, 877 aa, Artificial Sequence
  Synthetic FIX-XTEN Fusion Protein pJH64
MQRVNMIMAESPGLITICLLGYLLSAECTVFLDHENANKILNRPKRYNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDGAPSPAGSPTSTEEGTSESATPESGPGSEPATSGSETPGTSESATPESGPGTSTEPSEGSAPGTSTEPSEGSAPGASSNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLLSTKFTIYNNMFCAGFHEGGRDSCQGDSGGPHVTEVEGTSFLTGIISWGEECAMKGKYGIYTKVSRYVNWIKEKTKLTGAGSPGAETALVPRSFLLRNPNDKYEPFWEDEESGAGSPGAETAGAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAPASS

SEQ ID NO: 132 - protein, 733 aa, Artificial Sequence
  Synthetic FIX-XTEN Fusion Protein pJH65
MQRVNMIMAESPGLITICLLGYLLSAECTVFLDHENANKILNRPKRYNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDGAPSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGASSNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLLSTKFTIYNNMFCAGFHEGGRDSCQGDSGGPHVTEVEGTSFLTGIISWGEECAMKGKYGIYTKVSRYVNWIKEKTKLTGAGSPGAETALVPRSFLLRNPNDKYEPFWEDEESGAGSPGAETAGAPTSESATPESGPGSEPATSGSETPGTSESATPESGPGSEPATSGSETPGTSESATPESGPGTSTEPSEGSAPGASS

SEQ ID NO: 133 - protein, 805 aa, Artificial Sequence
  Synthetic FIX-XTEN Fusion Protein pJH66
MQRVNMIMAESPGLITICLLGYLLSAECTVFLDHENANKILNRPKRYNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDGAPSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGASSNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLLSTKFTIYNNMFCAGFHEGGRDSCQGDSGGPHVTEVEGTSFLTGIISWGEECAMKGKYGIYTKVSRYVNWIKEKTKLTGAGSPGAETALVPRSFLLRNPNDKYEPFWEDEESGAGSPGAETAGAPTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAPGASS

SEQ ID NO: 134 - protein, 949 aa, Artificial Sequence
  Synthetic FIX-XTEN Fusion Protein pJH67
MQRVNMIMAESPGLITICLLGYLLSAECTVFLDHENANKILNRPKRYNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDGAPSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGASSNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLLSTKFTIYNNMFCAGFHEGGRDSCQGDSGGPHVTEVEGTSFLTGIISWGEECAMKGKYGIYTKVSRYVNWIKEKTKLTGAGSPGAETALVPRSFLLRNPNDKYEPFWEDEESGAGSPGAETAGAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAPASS

SEQ ID NO: 135 - protein, 545 aa, Artificial Sequence
  Synthetic FIX-XTEN Fusion Protein pJH68
MQRVNMIMAESPGLITICLLGYLLSAECTVFLDHENANKILNRPKRYNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNGAPGSPAGSPTSTEEGTSESATPESGPGSEPATSGSETPASSKVVCSCTEGYRLAENQKSCEPAVPFPCGRVSVSQTSKLTRAETVFPDVDYVNSTEAETILDGAPGSPAGSPTSTEEGTSESATPESGPGSEPATSGSETPASSNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLLSTKFTIYNNMFCAGFHEGGRDSCQGDSGGPHVTEVEGTSFLTGIISWGEECAMKGKYGIYTKVSRYVNWIKEKTKLT

SEQ ID NO: 136 - protein, 581 aa, Artificial Sequence
  Synthetic FIX-XTEN Fusion Protein pJH69
MQRVNMIMAESPGLITICLLGYLLSAECTVFLDHENANKILNRPKRYNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNGAPGSPAGSPTSTEEGTSESATPESGPGSEPATSGSETPASSKVVCSCTEGYRLAENQKSCEPAVPFPCGRVSVSQTSKLTRAETVFPDVDYVNSTEAETILDGAPSPAGSPTSTEEGTSESATPESGPGSEPATSGSETPGTSESATPESGPGTSTEPSEGSAPGTSTEPSEGSAPGASSNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLLSTKFTIYNNMFCAGFHEGGRDSCQGDSGGPHVTEVEGTSFLTGIISWGEECAMKGKYGIYTKVSRYVNWIKEKTKLT

SEQ ID NO: 137 - protein, 653 aa, Artificial Sequence
  Synthetic FIX-XTEN Fusion Protein pJH70
MQRVNMIMAESPGLITICLLGYLLSAECTVFLDHENANKILNRPKRYNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNGAPGSPAGSPTSTEEGTSESATPESGPGSEPATSGSETPASSKVVCSCTEGYRLAENQKSCEPAVPFPCGRVSVSQTSKLTRAETVFPDVDYVNSTEAETILDGAPSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGASSNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLLSTKFTIYNNMFCAGFHEGGRDSCQGDSGGPHVTEVEGTSFLTGIISWGEECAMKGKYGIYTKVSRYVNWIKEKTKLT

SEQ ID NO: 138 - protein, 625 aa, Artificial Sequence
  Synthetic FIX-XTEN Fusion Protein pJH71
MQRVNMIMAESPGLITICLLGYLLSAECTVFLDHENANKILNRPKRYNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNGAPGSPAGSPTSTEEGTSESATPESGPGSEPATSGSETPASSKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLLSTKFTIYNNMFCAGFHEGGRDSCQGDSGGPHVTEVEGTSFLTGIISWGEECAMKGKYGIYTKVSRYVNWIKEKTKLTGAGSPGAETALVPRSFLLRNPNDKYEPFWEDEESGAGSPGAETAGAPTSESATPESGPGSEPATSGSETPGTSESATPESGPGSEPATSGSETPGTSESATPESGPGTSTEPSEGSAPGASS

SEQ ID NO: 139 - protein, 697 aa, Artificial Sequence
  Synthetic FIX-XTEN Fusion Protein pJH72
MQRVNMIMAESPGLITICLLGYLLSAECTVFLDHENANKILNRPKRYNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNGAPGSPAGSPTSTEEGTSESATPESGPGSEPATSGSETPASSKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLLSTKFTIYNNMFCAGFHEGGRDSCQGDSGGPHVTEVEGTSFLTGIISWGEECAMKGKYGIYTKVSRYVNWIKEKTKLTGAGSPGAETALVPRSFLLRNPNDKYEPFWEDEESGAGSPGAETAGAPTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAPGASS

SEQ ID NO: 140 - protein, 841 aa, Artificial Sequence
  Synthetic FIX-XTEN Fusion Protein pJH73
MQRVNMIMAESPGLITICLLGYLLSAECTVFLDHENANKILNRPKRYNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNGAPGSPAGSPTSTEEGTSESATPESGPGSEPATSGSETPASSKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLLSTKFTIYNNMFCAGFHEGGRDSCQGDSGGPHVTEVEGTSFLTGIISWGEECAMKGKYGIYTKVSRYVNWIKEKTKLTGAGSPGAETALVPRSFLLRNPNDKYEPFWEDEESGAGSPGAETAGAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAPASS

SEQ ID NO: 141 - protein, 545 aa, Artificial Sequence
  Synthetic FIX-XTEN Fusion Protein pJH74
MQRVNMIMAESPGLITICLLGYLLSAECTVFLDHENANKILNRPKRYNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNGAPGSPAGSPTSTEEGTSESATPESGPGSEPATSGSETPASSKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVEGAPGSPAGSPTSTEEGTSESATPESGPGSEPATSGSETPASSTGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLLSTKFTIYNNMFCAGFHEGGRDSCQGDSGGPHVTEVEGTSFLTGIISWGEECAMKGKYGIYTKVSRYVNWIKEKTKLT

SEQ ID NO: 142 - protein, 545 aa, Artificial Sequence
  Synthetic FIX-XTEN Fusion Protein pJH75
MQRVNMIMAESPGLITICLLGYLLSAECTVFLDHENANKILNRPKRYNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDGAPGSPAGSPTSTEEGTSESATPESGPGSEPATSGSETPASSNITQSTQSFNDFTRVVGGEDAKPGQFPWQVVLNGKVDAFCGGSIVNEKWIVTAAHCVEGAPGSPAGSPTSTEEGTSESATPESGPGSEPATSGSETPASSTGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLLSTKFTIYNNMFCAGFHEGGRDSCQGDSGGPHVTEVEGTSFLTGIISWGEECAMKGKYGIYTKVSRYVNWIKEKTKLT

SEQ ID NO: 143 - protein, 581 aa, Artificial Sequence
  Synthetic FIX-XTEN Fusion Protein pJH76
MQRVNMIMAESPGLITICLLGYLLSAECTVFLDHENANKILNRPKRYNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDGAPSPAGSPTSTEEGTSESATPESGPGSEPATSGSETPGTSESATPESGPGTSTEPSEGSAPGTSTEPSEGSAPGASSNITQSTQSFNDFTRVVGGEDAKPGQFPWQVVLNGKVDAFCGGSIVNEKWIVTAAHCVEGAPGSPAGSPTSTEEGTSESATPESGPGSEPATSGSETPASSTGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLLSTKFTIYNNMFCAGFHEGGRDSCQGDSGGPHVTEVEGTSFLTGIISWGEECAMKGKYGIYTKVSRYVNWIKEKTKLT

SEQ ID NO: 144 - protein, 653 aa, Artificial Sequence
  Synthetic FIX-XTEN Fusion Protein pJH77
MQRVNMIMAESPGLITICLLGYLLSAECTVFLDHENANKILNRPKRYNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDGAPSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGASSNITQSTQSFNDFTRVVGGEDAKPGQFPWQVVLNGKVDAFCGGSIVNEKWIVTAAHCVEGAPGSPAGSPTSTEEGTSESATPESGPGSEPATSGSETPASSTGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLLSTKFTIYNNMFCAGFHEGGRDSCQGDSGGPHVTEVEGTSFLTGIISWGEECAMKGKYGIYTKVSRYVNWIKEKTKLT

SEQ ID NO: 145 - protein, 625 aa, Artificial Sequence
  Synthetic FIX-XTEN Fusion Protein pJH78
MQRVNMIMAESPGLITICLLGYLLSAECTVFLDHENANKILNRPKRYNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVEGAPGSPAGSPTSTEEGTSESATPESGPGSEPATSGSETPASSTGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLLSTKFTIYNNMFCAGFHEGGRDSCQGDSGGPHVTEVEGTSFLTGIISWGEECAMKGKYGIYTKVSRYVNWIKEKTKLTGAGSPGAETALVPRSFLLRNPNDKYEPFWEDEESGAGSPGAETAGAPTSESATPESGPGSEPATSGSETPGTSESATPESGPGSEPATSGSETPGTSESATPESGPGTSTEPSEGSAPGASS

SEQ ID NO: 146 - protein, 697 aa, Artificial Sequence
  Synthetic FIX-XTEN Fusion Protein pJH79
MQRVNMIMAESPGLITICLLGYLLSAECTVFLDHENANKILNRPKRYNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVEGAPGSPAGSPTSTEEGTSESATPESGPGSEPATSGSETPASSTGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLLSTKFTIYNNMFCAGFHEGGRDSCQGDSGGPHVTEVEGTSFLTGIISWGEECAMKGKYGIYTKVSRYVNWIKEKTKLTGAGSPGAETALVPRSFLLRNPNDKYEPFWEDEESGAGSPGAETAGAPTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAPGASS

SEQ ID NO: 147 - protein, 841 aa, Artificial Sequence
  Synthetic FIX-XTEN Fusion Protein pJH80
MQRVNMIMAESPGLITICLLGYLLSAECTVFLDHENANKILNRPKRYNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVEGAPGSPAGSPTSTEEGTSESATPESGPGSEPATSGSETPASSTGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLLSTKFTIYNNMFCAGFHEGGRDSCQGDSGGPHVTEVEGTSFLTGIISWGEECAMKGKYGIYTKVSRYVNWIKEKTKLTGAGSPGAETALVPRSFLLRNPNDKYEPFWEDEESGAGSPGAETAGAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAPASS

SEQ ID NO: 148 - protein, 977 aa, Artificial Sequence
  Synthetic FIX-XTEN Fusion Protein pJH81
MQRVNMIMAESPGLITICLLGYLLSAECTVFLDHENANKILNRPKRYNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNGAPGSPAGSPTSTEEGTSESATPESGPGSEPATSGSETPASSKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLLSTKFTIYNNMFCAGFHEGGRDSCQGDSGGPHVTEVEGTSFLTGIISWGEECAMKGKYGIYTKVSRYVNWIKEKTKLTDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 149 - protein, 977 aa, Artificial Sequence
  Synthetic FIX-XTEN Fusion Protein pJH81
MQRVNMIMAESPGLITICLLGYLLSAECTVFLDHENANKILNRPKRYNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVEGAPGSPAGSPTSTEEGTSESATPESGPGSEPATSGSETPASSTGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLLSTKFTIYNNMFCAGFHEGGRDSCQGDSGGPHVTEVEGTSFLTGIISWGEECAMKGKYGIYTKVSRYVNWIKEKTKLTDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 150 - protein, 977 aa, Artificial Sequence
  Synthetic FIX-XTEN Fusion Protein pJH82
MQRVNMIMAESPGLITICLLGYLLSAECTVFLDHENANKILNRPKRYNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDGAPGSPAGSPTSTEEGTSESATPESGPGSEPATSGSETPASSNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLLSTKFTIYNNMFCAGFHEGGRDSCQGDSGGPHVTEVEGTSFLTGIISWGEECAMKGKYGIYTKVSRYVNWIKEKTKLTDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 151 - protein, 1013 aa, Artificial Sequence
  Synthetic FIX-XTEN Fusion Protein pJH84
MQRVNMIMAESPGLITICLLGYLLSAECTVFLDHENANKILNRPKRYNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDGAPSPAGSPTSTEEGTSESATPESGPGSEPATSGSETPGTSESATPESGPGTSTEPSEGSAPGTSTEPSEGSAPGASSNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLLSTKFTIYNNMFCAGFHEGGRDSCQGDSGGPHVTEVEGTSFLTGIISWGEECAMKGKYGIYTKVSRYVNWIKEKTKLTDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 152 - protein, 1085 aa, Artificial Sequence
  Synthetic FIX-XTEN Fusion Protein pJH85
MQRVNMIMAESPGLITICLLGYLLSAECTVFLDHENANKILNRPKRYNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDGAPSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGASSNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLLSTKFTIYNNMFCAGFHEGGRDSCQGDSGGPHVTEVEGTSFLTGIISWGEECAMKGKYGIYTKVSRYVNWIKEKTKLTDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 153 - protein, 935 aa, Artificial Sequence
  Synthetic FIX-XTEN Fusion Protein pJH56
MQRVNMIMAESPGLITICLLGYLLSAECTVFLDHENANKILNRPKRYNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLLSTKFTIYNNMFCAGFHEGGRDSCQGDSGGPHVTEVEGTSFLTGIISWGEECAMKGKYGIYTKVSRYVNWIKEKTKLTDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 154 - protein, 20 aa, Artificial Sequence
  Synethetic PAS peptide
ASPAAPAPASPAAPAPSAPA

SEQ ID NO: 155 - protein, 20 aa, Artificial Sequence
  Synethetic PAS peptide
AAPASPAPAAPSAPAPAAPS

SEQ ID NO: 156 - protein, 20 aa, Artificial Sequence
  Synethetic PAS peptide
APSSPSPSAPSSPSPASPSS

SEQ ID NO: 157 - protein, 19 aa, Artificial Sequence
  Synethetic PAS peptide
APSSPSPSAPSSPSPASPS

SEQ ID NO: 158 - protein, 20 aa, Artificial Sequence
  Synethetic PAS peptide
SSPSAPSPSSPASPSPSSPA

SEQ ID NO: 159 - protein, 24 aa, Artificial Sequence
  Synethetic PAS peptide
AASPAAPSAPPAAASPAAPSAPPA

SEQ ID NO: 160 - protein, 20 aa, Artificial Sequence
  Synethetic PAS peptide
ASAAAPAAASAAASAPSAAA

SEQ ID NO: 161 - protein, 4 aa, Artificial Sequence
  Gly-Ser peptide linker
GGGS

SEQ ID NO: 162 - protein, 8 aa, Artificial Sequence
  Gly-Ser peptide linker
GGGSGGGS

SEQ ID NO: 163 - protein, 11 aa, Artificial Sequence
  albumin-binding peptide core sequence
DICLPRWGCLW

SEQ ID NO: 164 - protein, 32 aa, Artificial Sequence
  Synethetic CTP Peptide
DPRFQDSSSSKAPPPSLPSPSRLPGPSDTPIL

SEQ ID NO: 165 - protein, 28 aa, Artificial Sequence
  Synthetic CTP Peptide
SSSSKAPPPSLPSPSRLPGPSDTPILPQ

SEQ ID NO: 166 - protein, 9 aa, Artificial Sequence
  FXIa cleavage site
TQSFNDFTR

SEQ ID NO: 167 - protein, 10 aa, Artificial Sequence
  FXIa cleavage site
SVSQTSKLTR

SEQ ID NO: 168 - protein, 10 aa, Artificial Sequence
  thrombin cleavage site
DFLAEGGGVR

SEQ ID NO: 169 - protein, 7 aa, Artificial Sequence
  thrombin cleavage site
TTKIKPR

SEQ ID NO: 170 - protein, 5 aa, Artificial Sequence
  thrombin cleavage site
LVPRG

SEQ ID NO: 171 - protein, 5 aa, Artificial Sequence
  thrombin cleavage site
ALRPR

SEQ ID NO: 172 - protein, 12 aa, Artificial Sequence
  Synthetic Gly-Ser peptide linker
GGGSGGGSGGGS

SEQ ID NO: 173 - protein, 16 aa, Artificial Sequence
  Synthetic Gly-Ser peptide linker
GGGSGGGSGGGSGGGS

SEQ ID NO: 174 - protein, 20 aa, Artificial Sequence
  Synthetic Gly-Ser peptide linker
GGGSGGGSGGGSGGGSGGGS

SEQ ID NO: 175 - protein, 24 aa, Artificial Sequence
  Synthetic Gly-Ser peptide linker
GGGSGGGSGGGSGGGSGGGSGGGS

SEQ ID NO: 176 - protein, 28 aa, Artificial Sequence
  Synthetic Gly-Ser peptide linker
GGGSGGGSGGGSGGGSGGGSGGGSGGGS

SEQ ID NO: 177 - protein, 32 aa, Artificial Sequence
  Synthetic Gly-Ser peptide linker
GGGSGGGSGGGSGGGSGGGSGGGSGGGSGGGS

SEQ ID NO: 178 - protein, 36 aa, Artificial Sequence
  Synthetic Gly-Ser peptide linker
GGGSGGGSGGGSGGGSGGGSGGGSGGGSGGGSGGGS

SEQ ID NO: 179 - protein, 40 aa, Artificial Sequence
  Synthetic Gly-Ser peptide linker
GGGSGGGSGGGSGGGSGGGSGGGSGGGSGGGSGGGSGGGS

SEQ ID NO: 180 - protein, 5 aa, Artificial Sequence
  Synthetic Gly-Ser peptide linker
SGGGS

SEQ ID NO: 181 - protein, 9 aa, Artificial Sequence
  Synthetic Gly-Ser peptide linker
SGGGSGGGS

SEQ ID NO: 182 - protein, 13 aa, Artificial Sequence
  Synthetic Gly-Ser peptide linker
SGGGSGGGSGGGS

SEQ ID NO: 183 - protein, 17 aa, Artificial Sequence
  Synthetic Gly-Ser peptide linker
SGGGSGGGSGGGSGGGS

SEQ ID NO: 184 - protein, 21 aa, Artificial Sequence
  Synthetic Gly-Ser peptide linker
SGGGSGGGSGGGSGGGSGGGS

SEQ ID NO: 185 - protein, 25 aa, Artificial Sequence
  Synthetic Gly-Ser peptide linker
SGGGSGGGSGGGSGGGSGGGSGGGS

SEQ ID NO: 186 - protein, 29 aa, Artificial Sequence
  Synthetic Gly-Ser peptide linker
SGGGSGGGSGGGSGGGSGGGSGGGSGGGS

SEQ ID NO: 187 - protein, 33 aa, Artificial Sequence
  Synthetic Gly-Ser peptide linker
SGGGSGGGSGGGSGGGSGGGSGGGSGGGSGGGS

SEQ ID NO: 188 - protein, 37 aa, Artificial Sequence
  Synthetic Gly-Ser peptide linker
SGGGSGGGSGGGSGGGSGGGSGGGSGGGSGGGSGGGS

SEQ ID NO: 189 - protein, 41 aa, Artificial Sequence
  Synthetic Gly-Ser peptide linker
SGGGSGGGSGGGSGGGSGGGSGGGSGGGSGGGSGGGSGGGS

SEQ ID NO: 190 - protein, 6 aa, Artificial Sequence
  PAR1 Linker Motif
SFLLRN

SEQ ID NO: 191 - protein, 4 aa, Artificial Sequence
  PAR1 Linker Motif
PNDK

SEQ ID NO: 192 - protein, 5 aa, Artificial Sequence
  PAR1 Linker Motif
PNDKY

SEQ ID NO: 193 - protein, 6 aa, Artificial Sequence
  PAR1 Linker Motif
PNDKYE

SEQ ID NO: 194 - protein, 7 aa, Artificial Sequence
  PAR1 Linker Motif
PNDKYEP

SEQ ID NO: 195 - protein, 8 aa, Artificial Sequence
  PAR1 Linker Motif
PNDKYEPF

SEQ ID NO: 196 - protein, 9 aa, Artificial Sequence
  PAR1 Linker Motif
PNDKYEPFW

SEQ ID NO: 197 - protein, 10 aa, Artificial Sequence
  PAR1 Linker Motif
PNDKYEPFWE

SEQ ID NO: 198 - protein, 11 aa, Artificial Sequence
  PAR1 Linker Motif
PNDKYEPFWED

SEQ ID NO: 199 - protein, 12 aa, Artificial Sequence
  PAR1 Linker Motif
PNDKYEPFWEDE

SEQ ID NO: 200 - protein, 13 aa, Artificial Sequence
  PAR1 Linker Motif
PNDKYEPFWEDEE

SEQ ID NO: 201 - protein, 14 aa, Artificial Sequence
  PAR1 Linker Motif
PNDKYEPFWEDEES

SEQ ID NO: 202 - protein, 72 aa, Artificial Sequence
  Synthetic XTEN_AE72_2A_1 Motif
TSTEPSEGSAPGSPAGSPTSTEEGTSTEPSEGSAPGTSTEPSEGSAPGTSESATPESGPGTSTEPSEGSAPG

SEQ ID NO: 203 - protein, 72 aa, Artificial Sequence
  Synthetic XTEN_AE72_2A_2 Motiff
TSESATPESGPGSEPATSGSETPGTSTEPSEGSAPGTSTEPSEGSAPGTSESATPESGPGTSESATPESGPG

SEQ ID NO: 204 - protein, 72 aa, Artificial Sequence
  Synthetic XTEN_AE72_3B_1 Motiff
SPAGSPTSTEEGTSESATPESGPGSEPATSGSETPGTSESATPESGPGTSTEPSEGSAPGTSTEPSEGSAPG

SEQ ID NO: 205 - protein, 72 aa, Artificial Sequence
  Synthetic XTEN_AE72_3B_2 Motiff
TSTEPSEGSAPGTSTEPSEGSAPGTSTEPSEGSAPGTSTEPSEGSAPGSPAGSPTSTEEGTSTEPSEGSAPG

SEQ ID NO: 206 - protein, 72 aa, Artificial Sequence
  Synthetic XTEN_AE72_4A_2 Motiff
TSESATPESGPGSPAGSPTSTEEGSPAGSPTSTEEGSPAGSPTSTEEGTSESATPESGPGTSTEPSEGSAPG

SEQ ID NO: 207 - protein, 72 aa, Artificial Sequence
  Synthetic XTEN_AE72_5A_2 Motiff
SPAGSPTSTEEGTSESATPESGPGSEPATSGSETPGTSESATPESGPGSPAGSPTSTEEGSPAGSPTSTEEG

SEQ ID NO: 208 - protein, 72 aa, Artificial Sequence
  Synthetic XTEN_AE72_6B_1 Motiff
TSTEPSEGSAPGTSESATPESGPGTSESATPESGPGTSESATPESGPGSEPATSGSETPGSEPATSGSETPG

SEQ ID NO: 209 - protein, 72 aa, Artificial Sequence
  Synthetic XTEN_AE72_6B_2 Motiff
SPAGSPTSTEEGTSTEPSEGSAPGTSTEPSEGSAPGSEPATSGSETPGTSESATPESGPGTSTEPSEGSAPG

SEQ ID NO: 210 - protein, 72 aa, Artificial Sequence
  Synthetic XTEN_AE72_1A_1 Motiff
SPAGSPTSTEEGTSESATPESGPGTSTEPSEGSAPGSPAGSPTSTEEGTSTEPSEGSAPGTSTEPSEGSAPG

SEQ ID NO: 211 - protein, 72 aa, Artificial Sequence
  Synthetic XTEN_AE72_1A_2 Motiff
TSESATPESGPGSEPATSGSETPGSEPATSGSETPGSPAGSPTSTEEGTSESATPESGPGTSTEPSEGSAPG

SEQ ID NO: 212 - protein, 144 aa, Artificial Sequence
  Synthetic XTEN_AE144_1A Motiff
SPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPG

SEQ ID NO: 213 - protein, 150 aa, Artificial Sequence
  Synthetic AE150 Motif Motiff
GAPGSEPATSGSETPGTSESATPESGPGSEPATSGSETPGSPAGSPTSTEEGTSTEPSEGSAPGSEPATSGSETPGSEPATSGSETPGSEPATSGSETPGTSTEPSEGSAPGTSESATPESGPGSEPATSGSETPGTSTEPSEGSAPASS

SEQ ID NO: 214 - protein, 150 aa, Artificial Sequence
  Synthetic AG150 Motif
GAPGTPGSGTASSSPGSSTPSGATGSPGSSPSASTGTGPGSSPSASTGTGPGASPGTSSTGSPGASPGTSSTGSPGSSTPSGATGSPGSSPSASTGTGPGASPGTSSTGSPGSSPSASTGTGPGTPGSGTASSSPGSSTPSGATGSPASS

SEQ ID NO: 215 - protein, 294 aa, Artificial Sequence
  Synthetic AE294 Motif
GAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAPASS

SEQ ID NO: 216 - protein, 294 aa, Artificial Sequence
  Synthetic AG294 Motif
GAPPGASPGTSSTGSPGASPGTSSTGSPGTPGSGTASSSPGSSTPSGATGSPGTPGSGTASSSPGSSTPSGATGSPGTPGSGTASSSPGSSTPSGATGSPGSSTPSGATGSPGSSPSASTGTGPGSSPSASTGTGPGASPGTSSTGSPGTPGSGTASSSPGSSTPSGATGSPGSSPSASTGTGPGSSPSASTGTGPGASPGTSSTGSPGASPGTSSTGSPGSSTPSGATGSPGSSPSASTGTGPGASPGTSSTGSPGSSPSASTGTGPGTPGSGTASSSPGSSTPSGATGSASS

SEQ ID NO: 217 - protein, 36 aa, Artificial Sequence
  Synthetic AE36 Motif
GSPAGSPTSTEEGTSESATPESGPGSEPATSGSETP

SEQ ID NO: 218 - protein, 78 aa, Artificial Sequence; identical to SEQ ID NO: 35
  Synthetic AE78 Motif

SEQ ID NO: 219 - protein, 46 aa, Artificial Sequence
  Synthetic linker
GPEGPSKLTRAETGAGSPGAETAEQKLISEEDLSPATGHHHHHHHH

SEQ ID NO: 220 - protein, 25 aa, Artificial Sequence
  Synthetic linker
GAGSPGAETALVPRGAGSPGAETAG

SEQ ID NO: 221 - protein, 44 aa, Artificial Sequence
  Synthetic linker
GAGSPGAETALVPRSFLLRNPNDKYEPFWEDEESGAGSPGAETA

SEQ ID NO: 222 - protein, 23 aa, Artificial Sequence
  Synthetic linker
GPEGPSKLTRAETGAGSPGAETA

SEQ ID NO: 223 - protein, 22 aa, Artificial Sequence
  Synthetic linker
GGGGALRPRVVGGAGSPGAETA

SEQ ID NO: 224 - protein, 40 aa, Artificial Sequence
  Synthetic linker
GGGGTLDPRSFLLRNPNDKYEPFWEDEEKGGAGSPGAETA

SEQ ID NO: 225 - protein, 11 aa, Artificial Sequence
  Synthetic linker
GGAGSPGAETA

SEQ ID NO: 226 - protein, 798 aa, Artificial Sequence
  Synthetic FIX-XTEN polypeptide pSYN-FIX-102
MQRVNMIMAESPGLITICLLGYLLSAECTVFLDHENANKILNRPKRYNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLLSTKFTIYNNMFCAGFHEGGRDSCQGDSGGPHVTEVEGTSFLTGIISWGEECAMKGKYGIYTKVSRYVNWIKEKTKLTGPEGPSKLTRAETGAGSPGAETAGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAPGAETAEQKLISEEDLSPATGHHHHHH

SEQ ID NO: 227 - protein, 763 aa, Artificial Sequence
  Synthetic FIX-XTEN Polypeptide pSYN-FIX-216
MQRVNMIMAESPGLITICLLGYLLSAECTVFLDHENANKILNRPKRYNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDGPSPGSPTSTEEGTSESATPESGPGSEPATSGSETPGTSESATPESGPGTSTEPSEGSAPGTSTEPSEGSAPGASSNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLLSTKFTIYNNMFCAGFHEGGRDSCQGDSGGPHVTEVEGTSFLTGIISWGEECAMKGKYGIYTKVSRYVNWIKEKTKLTDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 228 - protein, 226 aa, Artificial Sequence
  Synthetic Polypeptide pSYN-FIX-216-Fc
DKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

What is claimed is:

1. A Factor IX (FIX) fusion protein comprising a R338L FIX (Padua) variant polypeptide and an XTEN that is inserted within the FIX variant polypeptide, wherein the FIX fusion protein comprises the amino acid sequence of SEQ ID NO: 2 with the XTEN inserted at an insertion site selected from the group consisting of amino acid 103 of SEQ ID NO: 2, amino acid 105 of SEQ ID NO: 2, amino acid 142 of SEQ ID NO: 2, amino acid 149 of SEQ ID NO: 2, amino acid 162 of SEQ ID NO: 2, amino acid 166 of SEQ ID NO: 2, amino acid 174 of SEQ ID NO: 2, amino acid 224 of SEQ ID NO: 2, amino acid 226 of SEQ ID NO: 2, amino acid 228 of SEQ ID NO: 2, amino acid 413 of SEQ ID NO: 2, and any combination thereof, wherein the FIX fusion protein exhibits procoagulant activity, and wherein the FIX fusion protein is capable of exhibiting at least a 1.5 fold greater in vivo half-life when compared to a R338L FIX (Padua) variant polypeptide lacking said XTEN insertion.

2. The FIX fusion protein of claim 1, wherein the insertion site corresponds to an amino acid selected from the group consisting of amino acid 149 of SEQ ID NO: 2, amino acid 162 of SEQ ID NO: 2, amino acid 166 of SEQ ID NO: 2, amino acid 174 of SEQ ID NO: 2 and any combination thereof.

3. The FIX fusion protein of claim 1, wherein the XTEN comprises at least 36 amino acids.

4. The FIX fusion protein of claim 1, which further comprises a second XTEN.

5. The FIX fusion protein of claim 1, wherein the XTEN is inserted within the FIX polypeptide at an insertion site corresponding to amino acid 166 of SEQ ID NO: 2.

6. The FIX fusion protein of claim 1, further comprising a first Fc domain.

7. The FIX fusion protein of claim 6, comprising a second Fc domain.

8. The FIX fusion protein of claim 7, which comprises two polypeptide chains, wherein
   (i) the first polypeptide chain comprises the first Fc domain fused to the N-terminus or C-terminus of the FIX polypeptide comprising the XTEN, and
   (ii) the second polypeptide chain comprises the second Fc domain,
   wherein the first Fc domain and the second Fc domain are associated by a covalent bond, wherein the covalent bond is a disulfide bond.

9. The FIX fusion protein of claim 1, wherein the XTEN comprises 76 amino acids.

10. The FIX fusion protein of claim 9, wherein the XTEN is inserted within the FIX polypeptide at an insertion site corresponding to amino acid 166 of SEQ ID NO: 2.

11. The FIX fusion protein of claim 1, comprising an amino acid sequence having at least 90% identity to the amino acid sequence set forth in SEQ ID NO: 227.

12. The FIX fusion protein of claim 1, wherein the FIX fusion protein is capable of exhibiting at least a 2 fold greater in vivo half-life as compared to a R388L FIX polypeptide lacking said XTEN insertion.

13. The FIX fusion protein of claim 1, wherein the FIX fusion protein is capable of exhibiting at least a 3 fold greater in vivo half-life as compared to a R388L FIX polypeptide lacking said XTEN insertion.

14. The FIX fusion protein of claim 1, wherein the in vivo half-life is measured following intravenous (IV) administration of a single bolus injection of 200 IU/kg of the FIX fusion protein to Factor IX deficient (HemB, B6.129P2-F9tm1Dws/J, MGI:1932297) mice.

15. A Factor IX (FIX) fusion protein comprising a first polypeptide chain and a second polypeptide chain, wherein:
   a) the first polypeptide chain comprises:
      i) a R338L FIX (Padua) variant polypeptide and an XTEN that is inserted within the FIX variant polypeptide, wherein the FIX fusion protein comprises the FIX polypeptide amino acid sequence of SEQ ID NO: 2 with the XTEN inserted at amino acid 166 of SEQ ID NO: 2, and wherein the XTEN comprises an amino acid sequence having 76 amino acids; and
      ii) a first Fc domain, wherein the first Fc domain is fused to the FIX variant polypeptide comprising the XTEN; and
   b) the second polypeptide chain comprises a second Fc domain;
   wherein the first Fc domain and the second Fc domain are associated by a covalent bond, wherein the covalent bond is a disulfide bond; wherein the FIX fusion protein exhibits procoagulant activity, and wherein the FIX fusion protein is capable of exhibiting at least a 1.5 fold greater in vivo half-life when compared to a R338L FIX (Padua) variant polypeptide lacking said XTEN insertion.

16. The FIX fusion protein of claim 15, wherein the first polypeptide chain comprises an amino acid sequence having at least 90% identity to the amino acid sequence set forth in SEQ ID NO: 227.

17. The FIX fusion protein of claim 15, wherein the second polypeptide chain comprises an amino acid sequence having at least 90% identity to the amino acid sequence set forth in SEQ ID NO: 228.

18. The FIX fusion protein of claim 15, wherein the first polypeptide chain comprises the amino acid sequence of SEQ ID NO: 227, without the signal peptide and without the pro-peptide (amino acids 1-46), and wherein the second polypeptide chain comprises the amino acid sequence of SEQ ID NO: 228.

19. The FIX fusion protein of claim 15, wherein the FIX fusion protein is capable of exhibiting at least a 2 fold greater in vivo half-life as compared to a R388L FIX polypeptide lacking said XTEN insertion.

20. The FIX fusion protein of claim 15, wherein the FIX fusion protein is capable of exhibiting at least a 3 fold greater in vivo half-life as compared to a R388L FIX polypeptide lacking said XTEN insertion.

21. The FIX fusion protein of claim 15, wherein the in vivo half-life is measured following intravenous (IV) administration of a single bolus injection of 200 IU/kg of the FIX fusion protein to Factor IX deficient (HemB, B6.129P2-F9tm1Dws/J, MGI:1932297) mice.

22. A Factor IX (FIX) fusion protein comprising a first polypeptide chain and a second polypeptide chain, wherein the first polypeptide chain comprises FIX fusion protein comprising R338L FIX (Padua) variant and an XTEN that is inserted within the FIX variant polypeptide and Fc domain, said first polypeptide chain comprising the amino acid sequence of SEQ ID NO: 227, without the signal peptide and without the pro-peptide (amino acids 1-46), and wherein the second polypeptide chain comprises an Fc domain, said second polypeptide chain comprising the amino acid sequence of SEQ ID NO: 228.

23. A composition comprising the FIX fusion protein of claim 1 and a pharmaceutically acceptable carrier.

24. An isolated polynucleotide comprising a sequence encoding the FIX fusion protein of claim 1.

25. An expression vector comprising the polynucleotide of claim 24.

26. A host cell comprising the polynucleotide of claim 24.

27. A method of preventing, treating, ameliorating, or managing hemophilia B in a patient in need thereof comprising administering an effective amount of the FIX fusion protein of claim 1.

* * * * *